US011926835B1

(12) United States Patent
Čermák et al.

(10) Patent No.: US 11,926,835 B1
(45) Date of Patent: *Mar. 12, 2024

(54) METHODS FOR EFFICIENT TOMATO GENOME EDITING

(71) Applicant: INARI AGRICULTURE TECHNOLOGY, INC., Cambridge, MA (US)

(72) Inventors: Tomáš Čermák, Brookline, MA (US); Richard Bailey Flavell, Malibu, CA (US); Eva Konecna, Brookline, MA (US); Yajie Niu, Lexington, MA (US); Michael Lee Nuccio, Salem, NH (US); Jennifer A. Raji, Waltham, MA (US); Randall William Shultz, Acton, MA (US); Davide Sosso, Cambridge, MA (US); Maria Margarita D. Unson, Pawcatuck, CT (US); John Patrick Casey, Jr., Boston, MA (US); Michael Andreas Kock, Rheinfelden (DE)

(73) Assignee: INARI AGRICULTURE TECHNOLOGY, INC., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/261,233

(22) Filed: Jan. 29, 2019

Related U.S. Application Data

(60) Provisional application No. 62/623,481, filed on Jan. 29, 2018.

(51) Int. Cl.
*C12N 15/82* (2006.01)
*C12N 9/22* (2006.01)
*C12N 15/11* (2006.01)

(52) U.S. Cl.
CPC .......... *C12N 15/8213* (2013.01); *C12N 9/22* (2013.01); *C12N 15/11* (2013.01); *C12N 2310/20* (2017.05); *C12N 2800/80* (2013.01)

(58) Field of Classification Search
None
See application file for complete search history.

(56) References Cited

U.S. PATENT DOCUMENTS

| 5,605,011 | A | 2/1997 | Bedbrook et al. |
|---|---|---|---|
| 6,300,543 | B1 | 10/2001 | Cass et al. |
| 6,453,242 | B1 | 9/2002 | Eisenberg et al. |
| 6,479,626 | B1 | 11/2002 | Kim et al. |
| 6,534,261 | B1 | 3/2003 | Cox et al. |
| 6,762,344 | B1 | 7/2004 | Spencer et al. |
| 6,903,185 | B2 | 6/2005 | Kim et al. |
| 7,153,949 | B2 | 12/2006 | Kim et al. |
| 7,422,889 | B2 | 9/2008 | Sauer et al. |
| 7,691,995 | B2 | 4/2010 | Zamore et al. |
| 7,786,350 | B2 | 8/2010 | Allen et al. |
| 7,816,581 | B2 | 10/2010 | Gilbertson et al. |
| 8,030,473 | B2 | 10/2011 | Carrington et al. |
| 8,314,290 | B2 | 11/2012 | Allen et al. |
| 8,334,430 | B2 | 12/2012 | Allen et al. |
| 8,395,023 | B2 | 3/2013 | Gilbertson et al. |
| 8,404,928 | B2 | 3/2013 | Allen et al. |
| 8,410,334 | B2 | 4/2013 | Allen et al. |
| 8,697,359 | B1 * | 4/2014 | Zhang ............... C12N 15/85 |
| | | | 435/6.13 |
| 8,748,699 | B2 | 6/2014 | Reuzeau et al. |
| 8,771,945 | B1 | 7/2014 | Zhang |
| 8,795,965 | B2 | 8/2014 | Zhang |
| 8,816,153 | B2 | 8/2014 | Gilbertson et al. |
| 8,865,406 | B2 | 10/2014 | Zhang et al. |
| 8,871,445 | B2 | 10/2014 | Cong et al. |
| 8,889,356 | B2 | 11/2014 | Zhang |
| 8,889,418 | B2 | 11/2014 | Zhang et al. |
| 8,895,308 | B1 | 11/2014 | Zhang et al. |
| 8,906,616 | B2 | 12/2014 | Zhang et al. |
| 8,932,814 | B2 | 1/2015 | Cong et al. |
| 8,945,839 | B2 | 2/2015 | Zhang |
| 8,946,511 | B2 | 2/2015 | Allen et al. |
| 8,993,233 | B2 | 3/2015 | Zhang et al. |
| 8,999,641 | B2 | 4/2015 | Zhang et al. |
| 9,040,774 | B2 | 5/2015 | Ivashuta et al. |
| 9,139,838 | B2 | 9/2015 | Huang et al. |
| 9,192,112 | B2 | 11/2015 | Allen et al. |
| 2005/0053951 | A1 | 3/2005 | Breaker et al. |
| 2007/0011761 | A1 | 1/2007 | Thai et al. |
| 2009/0293148 | A1 | 11/2009 | Ren et al. |

(Continued)

FOREIGN PATENT DOCUMENTS

| WO | 2013160230 A1 | 10/2013 |
|---|---|---|
| WO | 2015131101 A1 | 9/2015 |

(Continued)

OTHER PUBLICATIONS

Soyk et al. Variation in the Flowering Gene Self Pruning 5G Promotes Day-Neutrality and Early Yield in Tomato. Nat. Genet. Jan. 2017;49(1):162-168. Epub Dec. 5, 2016. (Year: 2017).*
Pnueli et al. The Self-Pruning Gene of Tomato Regulates Vegetative to Reproductive Switching of Sympodial Meristems and Is the Ortholog of CEN and TFL1. Development. Jun. 1998;125(11):1979-89. (Year: 1998).*
Tomato Genome Consortium, The Tomato Genome Sequence Provides Insights Into Fleshy Fruit Evolution. Nature. May 30, 2012;485(7400):635-41. (Year: 2012).*
Schaeffer et al. CRISPR/Cas9-mediated Genome Editing and Gene Replacement in Plants: Transitioning From Lab to Field. Plant Sci. Nov. 2015;240:130-42. Epub Sep. 11, 2015. (Year: 2015).*
Bortesi et al. The CRISPR/Cas9 System for Plant Genome Editing and Beyond. Biotecnoladv. Jan.-Feb. 2015;33(1):41-52. Epub Dec. 20, 2014. (Year: 2015).*

(Continued)

*Primary Examiner* — Cynthia E Collins
(74) *Attorney, Agent, or Firm* — McKee, Voorhees & Sease, PLC

(57) ABSTRACT

The disclosure relates to improvements in methods for efficient editing of two or more endogenous tomato genes by insertion of one or more single stranded DNA donor molecules that are not homologous to the insertion sites in the tomato genome.

6 Claims, No Drawings

Specification includes a Sequence Listing.

(56) References Cited

U.S. PATENT DOCUMENTS

| | | | |
|---|---|---|---|
| 2013/0102651 | A1 | 4/2013 | Smolke et al. |
| 2013/0326645 | A1 | 12/2013 | Cost et al. |
| 2015/0059010 | A1 | 2/2015 | Cigan et al. |
| 2015/0082478 | A1 | 3/2015 | Cigan et al. |
| 2015/0089681 | A1 | 3/2015 | Van Der Oost et al. |
| 2015/0307889 | A1 | 10/2015 | Petolino et al. |
| 2015/0344912 | A1 | 12/2015 | Kim et al. |
| 2016/0017348 | A1 | 1/2016 | Jacobsen et al. |
| 2016/0138008 | A1 | 5/2016 | Doudna et al. |
| 2016/0194653 | A1 | 7/2016 | Cutler et al. |
| 2016/0208243 | A1 | 7/2016 | Zhang et al. |
| 2016/0264981 | A1 | 9/2016 | Yang et al. |
| 2016/0304891 | A1 | 10/2016 | Brower-Toland et al. |
| 2017/0037432 | A1 | 2/2017 | Donohoue et al. |
| 2017/0166912 | A1 | 6/2017 | Brower-Toland et al. |
| 2019/0264218 | A1 | 8/2019 | Shultz et al. |
| 2019/0352655 | A1 | 11/2019 | Niu et al. |

FOREIGN PATENT DOCUMENTS

| | | | |
|---|---|---|---|
| WO | 2016007347 | A1 | 1/2016 |
| WO | 2016007948 | A1 | 1/2016 |
| WO | 2016105185 | A1 | 6/2016 |
| WO | 2016123514 | A1 | 8/2016 |

OTHER PUBLICATIONS

Collonnier et al. Towards mastering CRISPR-induced gene knock-in in plants: Survey of key features and focus on the model Physcomitrella patens. Methods. May 15, 2017;121-122:103-117. Epub May 4, 2017. (Year: 2017).*

Weber et al. Plant Enhancers: A Call for Discovery. Trends Plant Sci. Nov. 2016;21(11):974-987. (Year: 2016).*

Que et al. The Frequency and Degree of Cosuppression by Sense Chalcone Synthase Transgenes Are Dependent on Transgene Promoter Strength and Are Reduced by Premature Nonsense Codons in the Transgene Coding Sequence. Plant Cell. Aug. 1997;9(8):1357-1368. (Year: 1997).*

Shlyueva et al. Transcriptional enhancers: from properties to genome-wide predictions. Nat. Rev. Genet. Apr. 2014;15(4):272-86. Epub Mar. 11, 2014. (Year: 2014).*

Bai et al., "Naturally Occurring Broad-Spectrum Powdery Mildew Resistance in a Central American Tomato Accession Is Caused by Loss of Mlo Function", MPMI, 2008, pp. 30-39, vol. 21, No. 1.

Barlett et al., "Mapping Genome-Wide Transcription Factor Binding Sites Using DAP-Seq", Nat. Protoc., 2017, pp. 1659-1672, vol. 12, No. 8.

Burgess et al., "Advances in Understanding Cis Regulation of the Plant Gene with Emphasis on Comparative Genomics", Current Opinion in Plant Biology, 2015, pp. 141-147, vol. 27.

Chen et al., "Tuning LeSPL-CNR Expression by SlymiR157 Affects Tomato Fruit Ripening", Scientific Reports, Jan. 2015, 6 pages, vol. 5, No. 7852.

Coppola et al., "Prosystemin Overexpression in Tomato Enhances Resistance to Different Biotic Stresses by Activating Genes of Multiple Signaling Pathways", Plant Mol. Biol. Rep., 2015, pp. 1270-1285, vol. 33.

ERISdb: a Database of Plant Splice Sites downloaded from <http://lemur.amu.edu.pl/share/ERISdb/home.html> on Mar. 2, 2020.

Fridman et al., "Zooming In on a Quantitative Trait for Tomato Yield Using Interspecific Introgressions", Science, 2004, pp. 1786-1789, vol. 305.

Fu et al., "LeNRT2.3 Functions in Nitrate Acquisition and Long-Distance Transport in Tomato", FEBS Letters, 2015, pp. 1072-1079, vol. 589.

He et al., "Improved Regulatory Element Prediction Based on Tissue-Specific Local Epigenomic Signatures", PNAS, 2017, pp. 1633-1640.

Hubbart et al., "The Photoprotective Protein PsbS Exerts Control Over CO2 Assimilation Rate in Fluctuating Light in Rice", The Plant Journal, 2012, pp. 402-412, vol. 71.

Jeong et al., "Tomato Male Sterile 1035 is Essential for Pollen Development and Meiosis in Anthers", Journal of Experimental Botany, 2014, pp. 6693-6709, vol. 65, No. 22.

Kagale et al., "EAR Motif-Mediated Transcriptional Repression in Plants", Epigenetics, 2011, pp. 141-146, vol. 6, No. 2.

Kim et al., "Genome Sequence of the Hot Pepper Provides Insights into the Evolution of Pungency in Capsicum Species", Nature Genetics, 2014, pp. 270-278, vol. 46, No. 3.

Kim et al., Supplementary Information "Genome Sequence of the Hot Pepper Provides insights into the Evolution of Pungency in Capsicum Species", Nature Genetics, 2014, 132 pages.

Krieger et al., "The Flowering Gene Single Flower Truss Drives Heterosis for Yield in Tomato", Nature Genetics, 2010, pp. 459-463, vol. 42, No. 5.

Kromdijk et al., "Improving Photosynthesis and Crop Productivity by Accelerating Recovery from Photoprotection", Plant Science, 2016, pp. 857-861, vol. 354.

Leonelli et al., "Transient Expression in Nicotiana benthamiana for Rapid Functional Analysis of Genes Involved n Non-Photochemical Quenching and Carotenoid Biosythesis", The Plant Journal, 2016, pp. 375-386, vol. 88.

Mout et al., "Directed Cytosolic Delivery of CRISPR/Cas9-Ribonucleoprotein for Efficient Gene Editing", ACS Nano, 2017, pp. 2452-2458, vol. 11.

Narsai et al., "Genome-Wide Analysis of mRNA Decay Rates and Their Determinants in *Arabidopsis thaliana*", The Plant Cell, 2007, pp. 3418-3436, vol. 19.

NCBI GenBank: AF202179.1 downloaded from the NCBI database world wide website <https://www.ncbi.nlm.nih.gov/nuccore> on Mar. 1, 2020.

NCBI Gene Accession ID GeneID, 101263981 downloaded from the NCBI database world wide website <https://www.ncbi.nlm.nih.gov/gene/> on Mar. 1, 2020.

NCBI Gene ID, 101253992 downloaded from the NCBI database world wide website <https://www.ncbi.nlm.nih.gov/gene/> on Mar. 1, 2020.

NCBI GeneID, 100037508 downloaded from the NCBI database world wide website <https://www.ncbi.nlm.nih.gov/gene/> on Mar. 1, 2020.

NCBI GeneID, 100240705). downloaded from the NCBI database world wide website <https://www.ncbi.nlm.nih.gov/gene/> on Mar. 1, 2020.

NCBI GeneID, 100736526 downloaded from the NCBI database world wide website <https://www.ncbi.nlm.nih.gov/gene/> on Mar. 1, 2020.

NCBI GeneID, 101246029 downloaded from the NCBI database world wide website <https://www.ncbi.nlm.nih.gov/gene/> on Mar. 1, 2020.

NCBI GeneID, 101254900 downloaded from the NCBI database world wide website <https://www.ncbi.nlm.nih.gov/gene/> on Mar. 1, 2020.

NCBI GeneID, 101256245 downloaded from the NCBI database world wide website <https://www.ncbi.nlm.nih.gov/gene/> on Mar. 1, 2020.

NCBI GeneID, 101266413 downloaded from the NCBI database world wide website <https://www.ncbi.nlm.nih.gov/gene/> on Mar. 1, 2020.

NCBI GeneID, 101268417) downloaded from the NCBI database world wide website <https://www.ncbi.nlm.nih.gov/gene/> on Mar. 1, 2020.

NCBI GeneID, 104644782 downloaded from the NCBI database world wide website <https://www.ncbi.nlm.nih.gov/gene/> on Mar. 1, 2020.

NCBI GeneID, 543827 downloaded from the NCBI database world wide website <https://www.ncbi.nlm.nih.gov/gene/> on Mar. 1, 2020.

NCBI GeneID, 543989 downloaded from the NCBI database world wide website <https://www.ncbi.nlm.nih.gov/gene/> on Mar. 1, 2020.

NCBI GeneID, 544038 downloaded from the NCBI database world wide website <https://www.ncbi.nlm.nih.gov/gene/> on Mar. 1, 2020.

(56) References Cited

OTHER PUBLICATIONS

NCBI GeneID, 544241 downloaded from the NCBI database world wide website <https://www.ncbi.nlm.nih.gov/gene/> on Mar. 1, 2020.
NCBI GeneID, 778228 downloaded from the NCBI database world wide website <https://www.ncbi.nlm.nih.gov/gene/> on Mar. 1, 2020.
NCBI GeneID: 543649 downloaded from the NCBI database world wide website <https://www.ncbi.nlm.nih.gov/gene/> on Mar. 1, 2020.
O'Malley et al., "Cistrome and Epicistrome Features Shape the Regulatory DNA Landscape", Cell, 2016, pp. 1280-1292, vol. 165.
Oka et al., "Genome-Wide Mapping of Transcriptional Enhancer Candidates Using DNA and Chromatin Features in Maize", Genome Biology, 2017, 24 pages, vol. 18. No. 137.
Park et al., "Optimization of Crop Productivity in Tomato Using Induced Mutations in the Florigen Pathway", Nature Genetics, 2014, pp. 1337-1342, vol. 46.
Park et al., "Rate of Meristem Maturation Determines Inflorescence Architecture in Tomato", PNAS, 2012, pp. 639-644, vol. 109, No. 2.
Pearson et al., "Improved Tools for biological Sequence Comparison", Proc. Natl. Acad. Sci. USA, 1988, pp. 2444-2448, vol. 85.
Ronen et al., "An Alternative Pathway to b-Carotene Formation in Plant Chromoplasts Discovered by Map-Based Cloning of Beta and Old-Gold Color Mutations in Tomato", PNAS, 2000, pp. 11102-11107, vol. 97, No. 20.
Soyk et al., "Bypassing Negative Epistasis on Yield in Tomato Imposed by a Domestication Gene", Cell, 2017, pp. 1142-1155, vol. 169.
Soyk et al., "Variation in the Flowering Gene Self Pruning 5G Promotes Day-Neutrality and Early Yield in Tomato", Nature Genetics, 2017, pp. 162-168, vol. 49, No. 1.
Szczesniak et al., "ERISdb: A Database of Plant Splice Sites and Splicing Signals", Plant Cell Physiol., 2013, 8 pages, vol. 54, No. 2.
Tai et al., "Expression of the Bs2 Pepper Gene Confers Resistance to Bacterial Spot Disease in Tomato", PNAS, 1999, pp. 14153-14158, vol. 96, No. 24.
Takken et al., "A Second Gene at the Tomato Cf-4 Locus Confers Resistance to Cladosporium fulvum Through Recognition of a Novel Avirulence Determinant", The Plant Journal, 1999, pp. 279-288, vol. 20, No. 3.
Taylor et al., "PAS Domains: Internal Sensors of Oxygen, Redox Potential, and Light", Microbiology and Molecular Biology Reviews, 1999, pp. 479-506, vol. 63, No. 2.
Thomazella et al., "CRISPR-Cas9 Mediated Mutagenesis of a DMR6 Ortholog in Tomato Confers Broad-Spectrum Disease Resistance", Preprint, 2016, 23 pages.
Tieman et al., "A Chemical Genetic Roadmap to Improved Tomato Flavor", Plant Science, 2017, pp. 391-394, vol. 255.
Ulmasov et al., "Aux/IAA Proteins Repress Expression of Reporter Genes Containing Natural and Highly Active Synthetic Auxin Response Elements", The Plant Cell, 1997, pp. 1963-1971, vol. 9.
Walker et al., "Molecular Mechanisms of Auxin Action", Current Opinion in Plant Biology, 1998, pp. 434-439, vol. 1.
Zhong et al., "Molecular Mechanism of Action of Plant DRM De Novo DNA Methyltransferases", Cell, 2014, pp. 1050-1060, vol. 157.
Zou et al., "Expression Profiling Soybean Response to Pseudomonas syringae Reveals New Defense-Related Genes and Rapid HR-Specific Downregulation of Photosynthesis", MPMI, 2005, pp. 1161-1174, vol. 18, No. 11.
"CrispRVariants: Tools for Counting and Visualising Mutations in a Target Location", Bioconductor, Retrieved Nov. 9, 2018, 4 pages, Release 3.8.
"ERISdb Database of Plant Splice Sites and Splicing Signals", ERISdb: a Database of Plant Splice Sites, Retrieved Nov. 9, 2018, 1 page.

Addgene, "Targeted DNA demethylation in vivo using dCas9-peptide repeat and scFv-TET1 catalytic domain fusions," 2016, Retrieved from https://www.addgene.org/browse/article/22324 on Nov. 9, 2018, 1 page.
Andersson et al., "Efficient Targeted Multiallelic Mutagenesis in Tetraploid Potato (Solanum tuberosum) by Transient CRISPR-Cas9 Expression in Protoplasts", Plant Cell Rep., 2017, pp. 117-128, vol. 36.
AtcisDB—Arabidopsis cis-regulatory element Database; downloaded on Jan. 30, 2019 from <https://agris-knowledgebase.org/AtcisDB/>.
Bahal et al., "In vivo correction of anaemia in b-thalassemic mice by gPNA-mediated gene editing with nanoparticle deliver", Nature Communications, Oct. 26, 2016, pp. 1-14.
Buchanan et al., "Phylogentic Analysis of 5'-Noncoding Regions from the ABA-Responsive rab16/17 Gene Family of Sorghum, Maize and Rice Provides Insight into the Composition, Organization and Function of cis-Regulatory Modules", Genetics, Nov. 1, 2004, pp. 1639-1654, vol. 168, No. 3.
Burstein et al., "New CRISPR-Cas systems from uncultivated microbes", Nature, Feb. 9, 2017, pp. 237-241, vol. 542, No. 7640.
Ellis et al., "The OCS Element: A 16 Base Pair Palindrome Essential for Activity of the Octopine Synthase Enhancer", The EMBO Journal, 1987, pp. 3203-3208, vol. 6, No. 11.
Guo et al., "Directed evolution of an enhanced and highly efficient FokI cleavage domain for Zinc Finger Nucleases", JMol Biol, Jul. 2, 2010, pp. 96-107, vol. 400, No. 1.
Hendel et al., "Chemically modified guide RNAs enhance CRISPR-Cas genome editing in human primary cells", Nat Biotechnol., Sep. 2015, pp. 985-989, vol. 33, No. 9.
Komorl et al., "Programmable editing of a target base in genomic DNA without double-stranded DNA cleavage", Nature, Oct. 20, 2016, pp. 420-424, vol. 533, No. 7603.
LeCong et al., "Multiplex Genome Engineering Using CRISPR/Cas Systems", Science, Feb. 15, 2013, pp. 819-823, vol. 339, No. 6121.
Liang et al., "Efficient DNA-free Genome Editing of Bread Wheat Using CRISPR/Cas9 Ribonucleoprotein Complexes", Nature Communications, Jan. 18, 2017, vol. 8, No. 14261.
Liu et al., "C2c1-sgRNA Complex Structure Reveals RNA-Guided DNA Cleavage Mechanism", Molecular Cell, Jan. 19, 2017, pp. 310-322, vol. 65, Elsevier Inc.
Mahfouz et al., "TALE nucleases and next generation GM Crops", GM Crops, Jun. 2011, pp. 99-103, vol. 2, No. 2, Landes Bioscience.
Morita et al., "Targeted DNA Demethylation in Vivo Using dCas9-peptide Repeat and scFv-TET1 Catalytic Domain Fusions", Bature Biotechnology, Aug. 29, 2016, pp. 1060-1065, vol. 34.
Newman et al., "DST Sequences, Highly Conserved Among Plant SAUR Genes, Target Reporter Transcripts for Rapid Decay in Tobacco", The Plant cell, 1993, pp. 701-714, vol. 5.
Office Action for U.S. Appl. No. 16/146,871 dated Mar. 20, 2020.
Peterson et al., "Genome-Wide Assessment of Efficiency and Specificity in CRISPR/Cas9 Mediated Multiple Site Targeting in *Arabidopsis*", PLOS One, Sep. 13, 2016, 11 pages.
Ran et al., "Double nicking by RNA-guided CRISPR Cas9 for enhanced genome editing specificity", Cell, Sep. 12, 2013, pp. 1380-1389, vol. 154, No. 6.
Ran et al., "Genome engineering using the CRISPR-Cas 9 system", Nat Protoc., Nov. 2013, pp. 2281-2308, vol. 8, No. 11.
Shen et al., "Rapid Generation of Genetic Diversity by Multiplex CRISPR/Cas9 Genome Editing in Rice", Science China Life Sciences, May 2017, pp. 506-515, vol. 60, No. 5.
Shmakov et al., "Discovery and functional characterization of diverse Class 2 CRISPR-Cas systems", Mol. Cell., Nov. 5, 2015, pp. 385-397, vol. 60, No. 3.
Svitashev et al., "Targeted Mutagenesis, Precise Gene Editing, and Site-Specific Gene Insertion in Maize using Cas9 and Guide RNA", Plant Physiology, 2015, pp. 931-945, vol. 169.
Thatcher et al., "Genome-Wide Analysis of Alternative Splicing in *Zea mays*: Landscape and Genetic Regulation", The Plant Cell, Sep. 2014, 16 pages.
Urnov et al., "Genome editing with engineered zinc finger nucleases", Nature Rev. Genet., Sep. 2010, pp. 636-646, vol. 11, Macmillan Publishers Limited.

(56) References Cited

OTHER PUBLICATIONS

Wang et al., "Simultaneous Editing of Three Homoeoalleles in Hexaploid in Hexaploid Bread Wheat Confers Heritable Resistance to Powdery Mildew", Nature Biotechnology, Sep. 2014, pp. 947-952, vol. 32, No. 9.

Xing et al., "A CRISPR/Cas 9 toolkit for multiplex genome editing in plants", BMC Plant Biology, 2014, pp. 1-12, vol. 14, No. 327.

Yanagisawa et al., "Metabolic Engineering with Dof1 Transcription Factor in Plants: Improved Nitrogen Assimilation and Growth Under Low-Nitrogen Conditions", Proceedings of the National Academy of Sciences USA, 2004, pp. 7833-7838, vol. 101.

Yang et al., "PAM-Dependent Target DNA Recognition and Cleavage by C2c1 CRISPR-Cas Endonuclease", Cell, Dec. 15, 2016, pp. 1814-1828, vol. 167, Elsevier Inc.

You et al., "Design of LNA probes that improve mismatch discrimination", Nucleic Acids Research, 2006, 11 pages, vol. 34, No. 8.

Zefu et al., "Combining ATAC-seq with nuclei sorting for discovery of cis-regulatory regions in plant genomes", Nucleic Acids Research, 2017, pp. e41, vol. 45, No. 6, Oxford University Press.

Zetschte et al., "Cpf1 Is a Single RNA-Guided Endonuclease of a Class 2 CRISPR-Cas System" Oct. 22, 2015, Cell, pp. 759-771, vol. 163, Elsevier Inc.

Zhang, et al., "Efficient and Transgene-Free Genome Editing in Wheat Through Transient Expression of CRISPR/Cas9 DNA or RNA", Nature Communication, 7:12617, Aug. 25, 2016, pp. 1-8.

Bolger, Anthony, et al., "The genome of the stress-tolerant wild tomato species *Solanum pennellii*", Nature Genetics, vol. 46, No. 9, pp. 1034-1039 Sep. 2014.

Intellectual Property Office of Singapore, "Second Written Opinion" in connection with Application No. 11201906795S, Application Filing Date Jan. 29, 2018, Date of Second Written Opinion dated Apr. 22, 2021, 8 pages, 2021.

Gil-Humanes et al., "High-efficiency gene targeting in hexaploid wheat using DNA replicons and CRISPR/Cas9", The Plant Journal, vol. 89, pp. 1251-1262, 2017.

Weinthal et al., "Plant Genome Editing and its Applications in Cereals", IntechOpen, DOI: 10.5772/66818, 15 pages, Dec. 14, 2016.

Richardson et al., "Enhancing homology-directed genome editing by catalytically active and inactive CRISPR-Cas9 using asymmetric donor DNA", Nature Biotechnology, vol. 34, No. 3, pp. 339-345, Mar. 2016.

United States Patent and Trademark Office in connection with U.S. Appl. No. 16/480,992, filed Jul. 25, 2019, "Final Office Action", 29 pages, dated Jan. 7, 2022.

* cited by examiner

METHODS FOR EFFICIENT TOMATO GENOME EDITING

CROSS-REFERENCE TO RELATED APPLICATIONS

This application claims the benefit of U.S. Provisional Patent Application No. 62/623,481, filed Jan. 29, 2018, which is incorporated herein by reference in its entirety.

INCORPORATION OF SEQUENCE LISTING

A sequence listing contained in the file named "10011US1_TC181663_ST25.txt" which is 4213917 bytes in size (measured in MS-Windows), which was created on Jan. 29, 2019, and which comprises 985 sequences, is electronically filed herewith and is incorporated herein by reference in its entirety. The sequence listing contained in the file named "39733US_sequencelisting.txt" which is 4.2 MB bytes in size, which was created on Jan. 29, 2018, which was filed on Jan. 29, 2018 as a part of U.S. Provisional Patent Application No. 62/623,481, and which comprises 985 sequences, is also incorporated herein by reference in its entirety.

FIELD OF THE INVENTION

Disclosed herein are novel tomato plant cells, tomato plants and tomato seeds derived from such plant cells and having enhanced traits, and methods of making and using such plant cells and derived plants and seeds.

BACKGROUND

Plant breeding and engineering currently relies on Mendelian genetics or recombinant techniques.

SUMMARY

Disclosed herein are methods for providing novel tomato plant cells or tomato plant protoplasts, plant callus, tissues or parts, whole tomato plants, and tomato seeds having one or more altered genetic sequences. Among other features, the methods and compositions described herein enable the stacking of preferred alleles without introducing unwanted genetic or epigenetic variation in the modified plants or plant cells. The efficiency and reliability of these targeted modification methods are significantly improved relative to traditional plant breeding, and can be used not only to augment traditional breeding techniques but also as a substitute for them.

In one aspect, the invention provides a method of changing expression of a sequence of interest in a genome, including integrating a sequence encoded by a polynucleotide, such as a double-stranded or single-stranded polynucleotides including DNA, RNA, or a combination of DNA and RNA, at the site of at least one double-strand break (DSB) in a genome, which can be the genome of a eukaryotic nucleus (e. g., the nuclear genome of a plant cell) or a genome of an organelle (e. g., a mitochondrion or a plastid in a plant cell). Effector molecules for site-specific introduction of a DSB into a genome include various endonucleases (e. g., RNA-guided nucleases such as a type II Cas nuclease, a Cas9, a type V Cas nuclease, a Cpf1, a CasY, a CasX, a C2c1, or a C2c3) and guide RNAs that direct cleavage by an RNA-guided nuclease. Embodiments include those where the DSB is introduced into a genome by a ribonucleoprotein complex containing both a site-specific nuclease (e. g., Cas9, Cpf1, CasX, CasY, C2c1, C2c3) and at least one guide RNA, or by a site-specific nuclease in combination with at least one guide RNA; in some of these embodiments no plasmid or other expression vector is utilized to provide the nuclease, the guide RNA, or the polynucleotide. These effector molecules are delivered to the cell or organelle wherein the DSB is to be introduced by the use of one or more suitable composition or treatment, such as at least one chemical, enzymatic, or physical agent, or application of heat or cold, ultrasonication, centrifugation, electroporation, particle bombardment, and bacterially mediated transformation. It is generally desirable that the DSB is induced at high efficiency. One measure of efficiency is the percentage or fraction of the population of cells that have been treated with a DSB-inducing agent and in which the DSB is successfully introduced at the correct site in the genome. The efficiency of genome editing is assessed by any suitable method such as a heteroduplex cleavage assay or by sequencing, as described elsewhere in this disclosure. In various embodiments, the DSB is introduced at a comparatively high efficiency, e. g., at about 20, about 30, about 40, about 50, about 60, about 70, or about 80 percent efficiency, or at greater than 80, 85, 90, or 95 percent efficiency. In embodiments, the DSB is introduced upstream of, downstream of, or within the sequence of interest, which is coding, non-coding, or a combination of coding and non-coding sequence. In embodiments, a sequence encoded by the polynucleotide (such as a double-stranded DNA, a single-stranded DNA, a single-stranded DNA/RNA hybrid, or a double-stranded DNA/RNA hybrid), when integrated into the site of the DSB in the genome, is then functionally or operably linked to the sequence of interest, e. g., linked in a manner that modifies the transcription or the translation of the sequence of interest or that modifies the stability of a transcript including that of the sequence of interest. Embodiments include those where two or more DSBs are introduced into a genome, and wherein a sequence encoded by a polynucleotide (such as a double-stranded DNA, a single-stranded DNA, a single-stranded DNA/RNA hybrid, or a double-stranded DNA/RNA hybrid) that is integrated into each DSB is the same or different for each of the DSBs. In embodiments, at least two DSBs are introduced into a genome by one or more nucleases in such a way that genomic sequence (coding, non-coding, or a combination of coding and non-coding sequence) is deleted between the DSBs (leaving a deletion with blunt ends, overhangs or a combination of a blunt end and an overhang), and a sequence encoded by a polynucleotide (such as a double-stranded DNA, a single-stranded DNA, a single-stranded DNA/RNA hybrid, or a double-stranded DNA/RNA hybrid) molecule is integrated between the DSBs (i. e., at the location of the deleted genomic sequence). The method is particularly useful for integrating into the site of a DSB a heterologous nucleotide sequence that provides a useful function or use. For example, the method is useful for integrating or introducing into the genome a heterologous sequence that stops or knocks out expression of a sequence of interest (such as a gene encoding a protein), or a heterologous sequence that is a unique identifier nucleotide sequence, or a heterologous sequence that is (or that encodes) a sequence recognizable by a specific binding agent or that binds to a specific molecule, or a heterologous sequence that stabilizes or destabilizes a transcript containing it. Embodiments include use of the method to integrate or introduce into a genome sequence of a promoter or promoter-like element (e. g., sequence of an auxin-binding or hormone-binding or transcription-factor-binding element, or sequence of or encoding an aptamer or riboswitch), or a sequence-specific binding or cleavage site sequence (e. g., sequence of or encoding an endonuclease cleavage site, a small RNA recognition site, a recombinase site, a splice site, or a transposon recognition site). In embodiments, the method is used to delete or otherwise modify to make non-functional an endogenous functional sequence, such as a hormone- or transcription-factor-binding element, or a small RNA or recombinase or transposon recognition site. In embodiments, additional molecules are used to effect a desired expression result or a desired genomic change. For example, the method is used to integrate heterologous recombinase recognition site sequences at two DSBs in a genome, and the appropriate recombinase molecule is employed to excise genomic sequence located between the recombinase recognition sites. In another example, the method is used to integrate a polynucleotide-encoded heterologous small RNA recognition site sequence at a DSB in a sequence of interest in a genome, wherein when the small RNA is present (e. g., expressed endogenously or transiently or transgenically), the small RNA binds to and cleaves the transcript of the sequence of interest that contains the integrated small RNA recognition site. In another example, the method is used to integrate in the genome of a tomato plant or plant cell a polynucleotide-encoded promoter or promoter-like element that is responsive to a specific molecule (e. g., an auxin, a hormone, a drug, an herbicide, or a polypeptide), wherein a specific level of expression of the sequence of interest is obtained by providing the corresponding specific molecule to the plant or plant cell; in a non-limiting example, an auxin-binding element is integrated into the promoter region of a protein-coding sequence in the genome of a plant or plant cell, whereby the expression of the protein is upregulated when the corresponding auxin is exogenously provided to the plant or plant cell (e. g., by adding the auxin to the medium of the plant cell or by spraying the auxin onto the plant). Another aspect of the invention is a tomato cell including in its genome a heterologous DNA sequence, wherein the heterologous sequence includes (a) nucleotide sequence of a polynucleotide integrated by the method at the site of a DSB in the genome, and (b) genomic nucleotide sequence adjacent to the site of the DSB; related aspects include a plant containing such a cell including in its genome a heterologous DNA sequence, progeny seed or plants (including hybrid progeny seed or plants) of the plant, and processed or commodity products derived from the plant or from progeny seed or plants. In another aspect, the invention provides a heterologous nucleotide sequence including (a) nucleotide sequence of a polynucleotide (such as a double-stranded DNA, a single-stranded DNA, a single-stranded DNA/RNA hybrid, or a double-stranded DNA/RNA hybrid) molecule integrated by the method at the site of a DSB in a genome, and (b) genomic nucleotide sequence adjacent to the site of the DSB; related aspects include larger polynucleotides such as a plasmid, vector, or chromosome including the heterologous nucleotide sequence, as well as a polymerase primer for amplification of the heterologous nucleotide sequence.

In another aspect, the invention provides a composition including a plant cell and a polynucleotide (such as a double-stranded DNA, a single-stranded DNA, a single-stranded DNA/RNA hybrid, or a double-stranded DNA/RNA hybrid) donor molecule that is capable of being integrated at (or having its sequence integrated at) a double-strand break in genomic sequence in the plant cell. In various embodiments, the plant cell is an isolated plant cell or plant protoplast, or is in a monocot plant or dicot plant, a zygotic or somatic embryo, seed, plant part, or plant tissue. In embodiments the plant cell is capable of division or differentiation. In embodiments the plant cell is haploid, diploid, or polyploid. In embodiments, the plant cell includes a double-strand break (DSB) in its genome, at which DSB site the polynucleotide donor molecule is integrated using methods disclosed herein. In embodiments, at least one DSB is induced in the plant cell's genome by including in the composition a DSB-inducing agent, for example, various endonucleases (e. g., RNA-guided nucleases such as a type II Cas nuclease, a Cas9, a type V Cas nuclease, a Cpf1, a CasY, a CasX, a C2c1, or a C2c3) and guide RNAs that direct cleavage by an RNA-guided nuclease; the dsDNA molecule is integrated into the DSB thus induced using methods disclose herein. Specific embodiments include compositions including a plant cell, at least one dsDNA molecule, and at least one ribonucleoprotein complex containing both a site-specific nuclease (e. g., Cas9, Cpf1, CasX, CasY, C2c1, C2c3) and at least one guide RNA; in some of these embodiments, the composition contains no plasmid or other expression vector for providing the nuclease, the guide RNA, or the dsDNA. In embodiments of the composition, the polynucleotide donor molecule is double-stranded DNA or RNA or a combination of DNA and RNA, and is blunt-ended, or contains one or more terminal overhangs, or contains chemical modifications such as phosphorothioate bonds or a detectable label. In other embodiments, the polynucleotide donor molecule is a single-stranded polynucleotide composed of DNA or RNA or a combination of DNA or RNA, and can further be chemically modified or labelled. In various embodiments of the composition, the polynucleotide donor molecule includes a nucleotide sequence that provides a useful function when integrated into the site of the DSB. For example, in various non-limiting embodiments the polynucleotide donor molecule includes: sequence that is recognizable by a specific binding agent or that binds to a specific molecule or encodes an RNA molecule or an amino acid sequence that binds to a specific molecule, or sequence that is responsive to a specific change in the physical environment or encodes an RNA molecule or an amino acid sequence that is responsive to a specific change in the physical environment, or heterologous sequence, or sequence that serves to stop transcription or translation at the site of the DSB, or sequence having secondary structure (e. g., double-stranded stems or stem-loops) or than encodes a transcript having secondary structure (e. g., double-stranded RNA that is cleavable by a Dicer-type ribonuclease). In particular embodiments, the modifications to the tomato cell or plant will affect the activity or expression of one or more genes or proteins listed in Table 5, and in some embodiments two or more of those genes or proteins. In related embodiments, the activity or expression of one or more genes or proteins listed in Table 5 will be altered by the introduction or creation of one or more of the regulatory sequences listed in Table 4.

In another aspect, the invention provides a reaction mixture including: (a) a tomato plant cell having at least one double-strand break (DSB) at a locus in its genome; and (b) a polynucleotide (such as a double-stranded DNA, a single-stranded DNA, a single-stranded DNA/RNA hybrid, or a double-stranded DNA/RNA hybrid) donor molecule capable of being integrated at (or having its sequence integrated at) the DSB (preferably by non-homologous end-joining (NHEJ)), wherein the polynucleotide donor molecule has a length of between about 18 to about 300 base-pairs (or nucleotides, if single-stranded), or between about 30 to about 100 base-pairs (or nucleotides, if single-stranded); wherein the polynucleotide donor molecule includes a sequence which, if integrated at the DSB, forms a heterologous insertion (wherein the sequence of the polynucleotide molecule is heterologous with respect to the genomic sequence flanking the insertion site or DSB). In embodiments of the reaction mixture, the plant cell is an isolated plant cell or plant protoplast. In various embodiments, the plant cell is an isolated plant cell or plant protoplast, or is in a monocot plant or dicot plant, a zygotic or somatic embryo, seed, plant part, or plant tissue. In embodiments the plant cell is capable of division or differentiation. In embodiments the plant cell is haploid, diploid, or polyploid. In embodiments of the reaction mixture, the polynucleotide donor molecule includes a nucleotide sequence that provides a useful function or use when integrated into the site of the DSB. For example, in various non-limiting embodiments the polynucleotide donor molecule includes: sequence that is recognizable by a specific binding agent or that binds to a specific molecule or encodes an RNA molecule or an amino acid sequence that binds to a specific molecule, or sequence that is responsive to a specific change in the physical environment or encodes an RNA molecule or an amino acid sequence that is responsive to a specific change in the physical environment, or heterologous sequence, or sequence that serves to stop transcription or translation at the site of the DSB, or sequence having secondary structure (e. g., double-stranded stems or stem-loops) or than encodes a transcript having secondary structure (e. g., double-stranded RNA that is cleavable by a Dicer-type ribonuclease).

In another aspect, the invention provides a polynucleotide for disrupting gene expression, wherein the polynucleotide is double-stranded and includes at least 18 contiguous base-pairs and encoding at least one stop codon in each possible reading frame on each strand, or is single-stranded and includes at least 11 contiguous nucleotides; and wherein the polynucleotide encodes at least one stop codon in each possible reading frame on each strand. In embodiments, the polynucleotide is a double-stranded DNA (dsDNA) or a double-stranded DNA/RNA hybrid molecule including at least 18 contiguous base-pairs and encoding at least one stop codon in each possible reading frame on either strand. In embodiments, the polynucleotide is a single-stranded DNA or a single-stranded DNA/RNA hybrid molecule including at least 11 contiguous nucleotides and encoding at least one stop codon in each possible reading frame on the strand. Such a polynucleotide is especially useful in methods disclosed herein, wherein, when a sequence encoded by the polynucleotide is integrated or inserted into a genome at the site of a DSB in a sequence of interest (such as a protein-coding gene), the sequence of the heterologously inserted polynucleotide serves to stop translation of the transcript containing the sequence of interest and the heterologously inserted polynucleotide sequence. Embodiments of the polynucleotide include those wherein the polynucleotide includes one or more chemical modifications or labels, e. g., at least one phosphorothioate modification.

In another aspect, the invention provides a method of identifying the locus of at least one double-stranded break (DSB) in genomic DNA in a cell (such as a plant cell) including the genomic DNA, wherein the method includes the steps of: (a) contacting the genomic DNA having a DSB with a polynucleotide (such as a double-stranded DNA, a single-stranded DNA, a single-stranded DNA/RNA hybrid, or a double-stranded DNA/RNA hybrid) donor molecule, wherein the polynucleotide donor molecule is capable of being integrated (or having its sequence integrated) at the DSB (preferably by non-homologous end-joining (NHEJ)) and has a length of between about 18 to about 300 base-pairs (or nucleotides, if single-stranded), or between about 30 to about 100 base-pairs (or nucleotides, if single-stranded); wherein a sequence encoded by the polynucleotide donor molecule, if integrated at the DSB, forms a heterologous insertion; and (b) using at least part of the sequence of the polynucleotide molecule as a target for PCR primers to allow amplification of DNA in the locus of the DSB. In a related aspect, the invention provides a method of identifying the locus of double-stranded breaks (DSBs) in genomic DNA in a pool of cells (such as plant cells or plant protoplasts), wherein the pool of cells includes cells having genomic DNA with a sequence encoded by a polynucleotide donor molecule inserted at the locus of the double stranded breaks; wherein the polynucleotide donor molecule is capable of being integrated (or having its sequence integrated) at the DSB and has a length of between about 18 to about 300 base-pairs (or nucleotides, if single-stranded), or between about 30 to about 100 base-pairs (or nucleotides, if single-stranded); wherein a sequence encoded by the polynucleotide donor molecule, if integrated at the DSB, forms a heterologous insertion; and wherein the sequence of the polynucleotide donor molecule is used as a target for PCR primers to allow amplification of DNA in the region of the double-stranded breaks. In embodiments, the pool of cells is a population of plant cells or plant protoplasts, wherein at least some of the cells contain multiple or different DSBs in the genome, each of which can be introduced into the genome by a different guide RNA.

In another aspect, the invention provides a method of identifying the nucleotide sequence of a locus in the genome that is associated with a phenotype, the method including the steps of: (a) providing to a population of cells having the genome: (i) multiple different guide RNAs (gRNAs) to induce multiple different double strand breaks (DSBs) in the genome, wherein each DSB is produced by an RNA-guided nuclease guided to a locus on the genome by one of the gRNAs, and (ii) polynucleotide (such as double-stranded DNA, single-stranded DNA, single-stranded DNA/RNA hybrid, and double-stranded DNA/RNA hybrid) donor molecules having a defined nucleotide sequence, wherein the polynucleotide donor molecules are capable of being integrated (or having their sequence integrated) into the DSBs by non-homologous end-joining (NHEJ); whereby when at least a sequence encoded by some of the polynucleotide donor molecules are inserted into at least some of the DSBs, a genetically heterogeneous population of cells is produced; (b) selecting from the genetically heterogeneous population of cells a subset of cells that exhibit a phenotype of interest; (c) using a pool of PCR primers that bind to at least part of the nucleotide sequence of the polynucleotide donor molecules to amplify from the subset of cells DNA from the locus of a DSB into which one of the polynucleotide donor molecules has been inserted; and (d) sequencing the amplified DNA to identify the locus associated with the phenotype of interest. In embodiments of the method, the gRNA is provided as a polynucleotide, or as a ribonucleoprotein including the gRNA and the RNA-guided nuclease. Related aspects include the cells produced by the method and pluralities, arrays, and genetically heterogeneous populations of such cells, as well as the subset of cells in which the locus associated with the phenotype has been identified, and callus, seedlings, plantlets, and plants and their seeds, grown or regenerated from such cells.

In another aspect, the invention provides a method of modifying a plant cell by creating a plurality of targeted modifications in the genome of the plant cell, wherein the method comprises contacting the genome with one or more targeting agents, wherein the one or more agents comprise or encode predetermined peptide or nucleic acid sequences, wherein the predetermined peptide or nucleic acid sequences bind preferentially at or near predetermined target sites within the plant genome, and wherein the binding directs or facilitates the generation of the plurality of targeted modifications within the genome; wherein the plurality of targeted modifications occurs without an intervening step of separately identifying an individual modification and without a step of separately selecting for the occurrence of an individual modification among the plurality of targeted modifications mediated by the targeting agents; and wherein the targeted modifications alter at least one trait of the plant cell, or at least one trait of a plant comprising the plant cell, or at least one trait of a plant grown from the plant cell, or result in a detectable phenotype in the modified plant cell; and wherein at least two of the targeted modifications are insertions of predetermined sequences encoded by one or more polynucleotide donor molecules, and wherein at least one of the polynucleotide donor molecules lacks homology to the genome sequences adjacent to the site of insertion. In a related embodiment, at least one of the polynucleotide donor molecules used in the method is a single stranded DNA molecule, a single stranded RNA molecule, a single stranded DNA-RNA hybrid molecule, or a duplex RNA-DNA molecule. In another related embodiment, wherein the modified plant cell of the method is a meristematic cell, embryonic cell, or germline cell. In yet another related embodiment, the methods described in this paragraph, when practiced repeatedly or on a pool of cells, result in an efficiency of at least 1%, e.g., at least 2%, 5%, 7%, 10%, 15%, 20%, 25%, 30%, 35% or more, wherein said efficiency is determined, e.g., by dividing the number of successfully targeted cells by the total number of cells targeted.

In another embodiment, the invention provides a method of modifying a plant cell by creating a plurality of targeted modifications in the genome of the plant cell, comprising: contacting the genome with one or more targeting agents, wherein the one or more agents comprise or encode predetermined peptide or nucleic acid sequences, wherein the predetermined peptide or nucleic acid sequences bind preferentially at or near predetermined target sites within the plant genome, and wherein the binding directs or facilitates the generation of the plurality of targeted modifications within the genome; wherein the plurality of targeted modifications occurs without an intervening step of separately identifying an individual modification and without a step of separately selecting for the occurrence of an individual modification among the plurality of targeted modifications mediated by the targeting agents; and wherein the targeted modifications improve at least one trait of the plant cell, or at least one trait of a plant comprising the plant cell, or at least one trait of a plant grown from the plant cell, or result in a detectable phenotype in the modified plant cell; and wherein at least one of the targeted modifications is an insertion of a predetermined sequence encoded by one or more polynucleotide donor molecules, and wherein at least one of the polynucleotide donor molecules is a single stranded DNA molecule, a single stranded RNA molecule, a single stranded DNA-RNA hybrid molecule, or a duplex RNA-DNA molecule. In a related embodiment, at least one of the polynucleotide donor molecules used in the method lacks homology to the genome sequences adjacent to the site of insertion. In another related embodiment, the modified plant cell is a meristematic cell, embryonic cell, or germline cell. In yet another related embodiment, repetition of the methods described in this paragraph result in an efficiency of at least 1%, e.g., at least 2%, 5%, 7%, 10%, 15%, 20%, 25%, 30%, 35% or more, wherein said efficiency is determined by dividing the number of successfully targeted cells by the total number of cells targeted. In embodiments, the two or more loci are alleles of a given sequence of interest; when all alleles of a given gene or sequence of interest are modified in the same way, the result is homozygous modification of the gene. For example, embodiments of the method enable targeted modification of both alleles of a gene in a diploid (2n ploidy, where n=1) plant, or targeted modification of all three alleles in a triploid (2n ploidy, where n=1.5) plant, or targeted modification of all six alleles of a gene in a hexaploid (2n ploidy, where n=3) plant. In a related embodiment, the targeted plant cell has a ploidy of 2n, with n being a value selected from the group consisting of 0.5, 1, 1.5, 2, 2.5, 3, 3.5, 4, 5, and 6, wherein the method generates 2n targeted modifications at 2n loci of the predetermined target sites within the plant cell genome; and wherein 2n of the targeted modifications are insertions or creations of predetermined sequences encoded by one or more polynucleotide donor molecules.

In another embodiment, the invention provides a method of modifying a plant cell by creating a plurality of targeted modifications in the genome of the plant cell, comprising: contacting the genome with one or more targeting agents, wherein the one or more agents comprise or encode predetermined peptide or nucleic acid sequences, wherein the predetermined peptide or nucleic acid sequences bind preferentially at or near predetermined target sites within the plant genome, and wherein the binding directs the generation of the plurality of targeted modifications within the genome; wherein the plurality of modifications occurs without an intervening step of separately identifying an individual modification and without a step of separately selecting for the occurrence of an individual modification among the plurality of targeted modifications mediated by the targeting agents; wherein the targeted modifications improve at least one trait of the plant cell, or at least one trait of a plant comprising the plant cell, or at least one trait of a plant or seed obtained from the plant cell, or result in a detectable phenotype in the modified plant cell; and wherein the modified plant cell is a meristematic cell, embryonic cell, or germline cell. In a related embodiment, at least one of the targeted modifications is an insertion of a predetermined sequence encoded by one or more polynucleotide donor molecules, and wherein at least one of the polynucleotide donor molecules is a single stranded DNA molecule, a single stranded RNA molecule, a single stranded DNA-RNA hybrid molecule, or a duplex RNA-DNA molecule. In yet another related embodiment, at least one of the polynucleotide donor molecules lacks homology to the genome sequences adjacent to the site of insertion. In yet another embodiment related to the methods of this paragraph, repetition of the method results in an efficiency of at least 1%, e.g., at least 2%, 5%, 7%, 10%, 15%, 20%, 25%, 30%, 35% or more, wherein said efficiency is determined by dividing the number of successfully targeted cells by the total number of cells targeted.

In another embodiment, the invention provides a method of modifying a tomato plant cell by creating a plurality of targeted modifications in the genome of the plant cell, comprising: contacting the genome with one or more targeting agents, wherein the one or more agents comprise or encode predetermined peptide or nucleic acid sequences, wherein the predetermined peptide or nucleic acid sequences bind preferentially at or near predetermined target sites within the plant genome, and wherein the binding directs the generation of the plurality of targeted modifications within the genome; wherein the plurality of modifications occurs without an intervening step of separately identifying an individual modification and without a step of separately selecting for the occurrence of an individual modification among the plurality of targeted modifications mediated by the targeting agents; and wherein the targeted modifications improve at least one trait of the plant cell, or at least one trait of a plant comprising the plant cell, or at least one trait of a plant or seed obtained from the plant cell, or result in a detectable phenotype in the modified plant cell; and wherein repetition of the aforementioned steps results in an efficiency of at least 1%, e.g., at least 2%, 5%, 7%, 10%, 15%, 20%, 25%, 30%, 35% or more, wherein said efficiency is determined by dividing the number of successfully targeted cells by the total number of cells targeted. In a related embodiment, the modified plant cell is a meristematic cell, embryonic cell, or germline cell. In another related embodiment, at least one of the targeted modifications is an insertion of a predetermined sequence encoded by one or more polynucleotide donor molecules, and wherein at least one of the polynucleotide donor molecules is a single stranded DNA molecule, a single stranded RNA molecule, a single stranded DNA-RNA hybrid molecule, or a duplex RNA-DNA molecule. In yet another related embodiment of the methods of this paragraph, at least one of the polynucleotide donor molecules used in the method lacks homology to the genome sequences adjacent to the site of insertion.

In various embodiments of the methods described above, at least one of the targeted modifications is an insertion between 3 and 400 nucleotides in length, between 10 and 350 nucleotides in length, between 18 and 350 nucleotides in length, between 18 and 200 nucleotides in length, between 10 and 150 nucleotides in length, or between 11 and 100 nucleotides in length. In certain, embodiments, two of the targeted modifications are insertions between 10 and 350 nucleotides in length, between 18 and 350 nucleotides in length, between 18 and 200 nucleotides in length, between 10 and 150 nucleotides in length, or between 11 and 100 nucleotides in length.

In another variation of the methods described above, at least two insertions are made, and at least one of the insertions is an upregulatory sequence. In yet another variation, the targeted modification methods described above insert or create at least one transcription factor binding site. In yet another variation of the methods described above, the insertion or insertions of predetermined sequences into the plant genome are accompanied by the deletion of sequences from the plant genome.

In yet another embodiment of the targeted modification methods described above, the methods further comprise obtaining a plant from the modified plant cell and breeding the plant. In yet another embodiment, the methods described above comprise a step of introducing additional genetic or epigenetic changes into the modified plant cell or into a plant grown from the modified plant cell.

In an embodiment of the targeted modification methods described above, at least two targeted insertions are made and the targeted insertions independently up- or downregulate the expression of two or more distinct genes. For example, a targeted insertion may increase expression at least 10%, 15%, 20%, 25%, 30%, 35%, 40%, 50%, 60%, 70%, 80%, 90%, 95%, 100% or greater, e.g., at least a 2-fold, 5-fold, 10-fold, 20-fold, 30-fold, 40-fold, 50-fold change, 100-fold or even 1000-fold change or more. In some embodiments, expression is increased between 10-100%; between 2-fold and 5-fold; between 2 and 10-fold; between 10-fold and 50-fold; between 10-fold and a 100-fold; between 100-fold and 1000-fold; between 1000-fold and 5,000-fold; between 5,000-fold and 10,000 fold. In some embodiments, a targeted insertion may decrease expression by at least 1%, 5%, 10%, 15%, 20%, 25%, 30%, 35%, 40%, 50%, 60%, 70%, 80%, 90%, 95%, 99% or more.

In yet another embodiment of the targeted insertion methods described above, the donor polynucleotide is tethered to a crRNA by a covalent bond, a non-covalent bond, or a combination of covalent and non-covalent bonds. In a related embodiment, the invention provides a composition for targeting a genome comprising a donor polynucleotide tethered to a cRNA by a covalent bond, a non-covalent bond, or a combination of covalent and non-covalent bonds.

In another embodiment of the targeted modification methods described above, the loss of epigenetic marks after modifying occurs in less than 0.1%, 0.08%, 0.05%, 0.02%, or 0.01% of the genome. In yet another embodiment of the targeted modification methods described above, the genome of the modified plant cell is more than 99%, e.g., more than 99.5% or more than 99.9% identical to the genome of the parent cell.

In yet another embodiment of the targeted modification methods described above, at least one of the targeted modifications is an insertion and at least one insertion is in a region of the genome that is recalcitrant to meiotic or mitotic recombination.

In certain embodiments of the plant cell genome targeting methods described above, the plant cell is a member of a pool of cells being targeted. In related embodiments, the modified cells within the pool are characterized by sequencing after targeting.

The invention also provides modified tomato plant cells comprising at least two separately targeted insertions in its genome, wherein the insertions are determined relative to a parent plant cell, and wherein the modified plant cell is devoid of mitotically or meiotically generated genetic or epigenetic changes relative to the parent plant cell. In certain embodiments, these plant cells are obtained using the multiplex targeted insertion methods described above. In certain embodiments, the modified plant cells comprise at least two separately targeted insertions, wherein the genome of the modified plant cell is at least 95%, at least 96%, at least 97%, at least 98%, at least 99%, at least 99.5%, at least 99.9%, or at least 99.99% identical to the parent cell, taking all genetic or epigenetic changes into account.

While the introgression of certain traits and transgenes into plants has been successful, achieving a homozygous modified plant in one step (i.e., modifying all targeted loci simultaneously) has not been previously described. Plants homozygous for, e.g., targeted insertions could only be obtained by further crossing and/or techniques involving double-haploids. These techniques are not only time consuming and laborious, they also lead to plants which deviate from the original plant not only for the targeted insertion but also for other changes as a consequence of the techniques employed to enable homozygosity. As such changes could have unintended and unpredictable consequences and may require further testing or screening, they are clearly undesired in a breeding process. In certain embodiments, the invention provides methods of making a targeted mutation and/or targeted insertion in all of the 2n targeted loci in a plant genome in one step. In embodiments, the two or more loci are alleles of a given sequence of interest; when all alleles of a given gene or sequence of interest are modified in the same way, the result is homozygous modification of the gene. For example, embodiments of the method enable targeted modification of both alleles of a gene in a diploid (2n ploidy, where n=1) plant, or targeted modification of all three alleles in a triploid (2n ploidy, where n=1.5) plant, or targeted modification of all six alleles of a gene in a hexaploid (2n ploidy, where n=3) plant.

The invention also provides modified plant cells resulting from any of the claimed methods described, as well as recombinant plants grown from those modified plant cells.

In some embodiments, the invention provides a method of manufacturing a processed plant product, comprising: (a) modifying a plant cell according to any of the targeted methods described above; (b) growing a modified plant from said plant cell, and (c) processing the modified plant into a processed product, thereby manufacturing a processed plant product. In related embodiments, the processed product may be meal, oil, juice, sugar, starch, fiber, an extract, wood or wood pulp, flour, cloth or some other commodity plant product. The invention also provides a method of manufacturing a plant product, comprising (a) modifying a plant cell according to any of the targeted methods described above, (b) growing an modified plant from said plant cell, and (c) harvesting a product of the modified plant, thereby manufacturing a plant product. In related embodiments, the plant product is a product may be leaves, fruit, vegetables, nuts, seeds, oil, wood, flowers, cones, branches, hay, fodder, silage, stover, straw, pollen, or some other harvested commodity product. In further related embodiments, the processed products and harvested products are packaged.

DETAILED DESCRIPTION OF THE INVENTION

Definitions

Unless otherwise stated, nucleic acid sequences in the text of this specification are given, when read from left to right, in the 5' to 3' direction. Nucleic acid sequences may be provided as DNA or as RNA, as specified; disclosure of one necessarily defines the other, as well as necessarily defines the exact complements, as is known to one of ordinary skill in the art. Where a term is provided in the singular, the inventors also contemplate aspects of the invention described by the plural of that term.

By "polynucleotide" is meant a nucleic acid molecule containing multiple nucleotides and refers to "oligonucleotides" (defined here as a polynucleotide molecule of between 2-25 nucleotides in length) and polynucleotides of 26 or more nucleotides. Polynucleotides are generally described as single- or double-stranded. Where a polynucleotide contains double-stranded regions formed by intra- or intermolecular hybridization, the length of each double-stranded region is conveniently described in terms of the number of base pairs. Aspects of this invention include the use of polynucleotides or compositions containing polynucleotides; embodiments include one or more oligonucleotides or polynucleotides or a mixture of both, including single- or double-stranded RNA or single- or double-stranded DNA or single- or double-stranded DNA/RNA hybrids or chemically modified analogues or a mixture thereof. In various embodiments, a polynucleotide (such as a single-stranded DNA/RNA hybrid or a double-stranded DNA/RNA hybrid) includes a combination of ribonucleotides and deoxyribonucleotides (e. g., synthetic polynucleotides consisting mainly of ribonucleotides but with one or more terminal deoxyribonucleotides or synthetic polynucleotides consisting mainly of deoxyribonucleotides but with one or more terminal dideoxyribonucleotides), or includes non-canonical nucleotides such as inosine, thiouridine, or pseudouridine. In embodiments, the polynucleotide includes chemically modified nucleotides (see, e. g., Verma and Eckstein (1998) Annu. Rev. Biochem., 67:99-134); for example, the naturally occurring phosphodiester backbone of an oligonucleotide or polynucleotide can be partially or completely modified with phosphorothioate, phosphorodithioate, or methylphosphonate internucleotide linkage modifications; modified nucleoside bases or modified sugars can be used in oligonucleotide or polynucleotide synthesis; and oligonucleotides or polynucleotides can be labelled with a fluorescent moiety (e. g., fluorescein or rhodamine or a fluorescence resonance energy transfer or FRET pair of chromophore labels) or other label (e. g., biotin or an isotope). Modified nucleic acids, particularly modified RNAs, are disclosed in U.S. Pat. No. 9,464,124, incorporated by reference in its entirety herein. For some polynucleotides (especially relatively short polynucleotides, e. g., oligonucleotides of 2-25 nucleotides or base-pairs, or polynucleotides of about 25 to about 300 nucleotides or base-pairs), use of modified nucleic acids, such as locked nucleic acids ("LNAs"), is useful to modify physical characteristics such as increased melting temperature ($T_m$) of a polynucleotide duplex incorporating DNA or RNA molecules that contain one or more LNAs; see, e. g., You et al. (2006) *Nucleic Acids Res.*, 34:1-11 (e60), doi:10.1093/nar/gk1175.

In the context of the genome targeting methods described herein, the phrase "contacting a genome" with an agent means that an agent responsible for effecting the targeted genome modification (e.g., a break, a deletion, a rearrangement, or an insertion) is delivered to the interior of the cell so the directed mutagenic action can take place.

In the context of discussing or describing the ploidy of a plant cell, the "n" (as in "a ploidy of 2n") refers to the number of homologous pairs of chromosomes, and is typically equal to the number of homologous pairs of gene loci on all chromosomes present in the cell.

The term "inbred variety" refers to a genetically homozygous or substantially homozygous population of plants that preferably comprises homozygous alleles at about 95%, preferably 98.5% or more of its loci. An inbred line can be developed through inbreeding (i.e., several cycles of selfing, more preferably at least 5, 6, 7 or more cycles of selfing) or doubled haploidy resulting in a plant line with a high uniformity. Inbred lines breed true, e.g., for one or more or all phenotypic traits of interest. An "inbred", "inbred individual, or "inbred progeny" is an individual sampled from an inbred line.

"F1, F2, F3, etc." refers to the consecutive related generations following a cross between two parent plants or parent lines. The plants grown from the seeds produced by crossing two plants or lines is called the F1 generation. Selfing the F1 plants results in the F2 generation, etc. "F1 hybrid" plant (or F1 hybrid seed) is the generation obtained from crossing two inbred parent lines. Thus, F1 hybrid seeds are seeds from which F1 hybrid plants grow. F1 hybrids are more vigorous and higher yielding, due to heterosis.

Hybrid seed: Hybrid seed is seed produced by crossing two different inbred lines (i.e. a female inbred line with a male inbred). Hybrid seed is heterozygous over a majority of its alleles.

As used herein, the term "variety" refers to a group of similar plants that by structural or genetic features and/or performance can be distinguished from other varieties within the same species.

The term "cultivar" (for cultivated variety) is used herein to denote a variety that is not normally found in nature but that has been created by humans, i.e., having a biological status other than a "wild" status, which "wild" status indicates the original non-cultivated, or natural state of a plant or accession. The term "cultivar" includes, but is not limited to, semi-natural, semi-wild, weedy, traditional cultivar, landrace, breeding material, research material, breeder's line, synthetic population, hybrid, founder stock/base population, inbred line (parent of hybrid cultivar), segregating population, mutant/genetic stock, and advanced/improved cultivar. The term "elite background" is used herein to indicate the genetic context or environment of a targeted mutation of insertion.

The term "dihaploid line" refers to stable inbred lines issued from another culture. Some pollen grains (haploid) cultivated on specific medium and circumstances can develop plantlets containing n chromosomes. These plantlets are then "double" and contain 2n chromosomes. The progeny of these plantlets are named "dihaploid" and are essentially not segregating any more (i.e., they are stable).

"F1 hybrid" plant (or F1 hybrid seed) is the generation obtained from crossing two inbred parent lines. Thus, F1 hybrid seeds are seeds from which F1 hybrid plants grow. F1 hybrids are more vigorous and higher yielding, due to heterosis. Inbred lines are essentially homozygous at most loci in the genome. A "plant line" or "breeding line" refers to a plant and its progeny. "F1", "F2", "F3", etc." refers to the consecutive related generations following a cross between two parent plants or parent lines. The plants grown from the seeds produced by crossing two plants or lines is called the F1 generation. Selfing the F1 plants results in the F2 generation, etc.

The term "allele(s)" means any of one or more alternative forms of a gene at a particular locus, all of which alleles relate to one trait or characteristic at a specific locus. In a diploid cell of an organism, alleles of a given gene are located at a specific location, or locus (loci plural), on a chromosome. One allele is present on each chromosome of the pair of homologous chromosomes. A diploid plant species may comprise a large number of different alleles at a particular locus. These may be identical alleles of the gene (homozygous) or two different alleles (heterozygous).

The term "locus" (loci plural) means a specific place or places or a site on a chromosome where for example a QTL, a gene or genetic marker is found.

The spontaneous (non-targeted) mutation rate for a single base pair is estimated to be $7 \times 10^{-9}$ per bp per generation. Assuming an estimated 30 replications per generation, this leads to an estimated spontaneous (non-targeted) mutation rate of $2 \times 10^{-10}$ mutations per base pair per replication event.

Tools and Methods for Multiplex Editing

CRISPR technology for editing the genes of eukaryotes is disclosed in U. S. Patent Application Publications 2016/0138008A1 and US2015/0344912A1, and in U.S. Pat. Nos. 8,697,359, 8,771,945, 8,945,839, 8,999,641, 8,993,233, 8,895,308, 8,865,406, 8,889,418, 8,871,445, 8,889,356, 8,932,814, 8,795,965, and 8,906,616. Cpf1 endonuclease and corresponding guide RNAs and PAM sites are disclosed in U. S. Patent Application Publication 2016/0208243 A1. Other CRISPR nucleases useful for editing genomes include C2c1 and C2c3 (see Shmakov et al. (2015) *Mol. Cell*, 60:385-397) and CasX and CasY (see Burstein et al. (2016) *Nature*, doi:10.1038/nature21059). Plant RNA promoters for expressing CRISPR guide RNA and plant codon-optimized CRISPR Cas9 endonuclease are disclosed in International Patent Application PCT/US2015/018104 (published as WO 2015/131101 and claiming priority to U.S. Provisional Patent Application 61/945,700). Methods of using CRISPR technology for genome editing in plants are disclosed in in U. S. Patent Application Publications US 2015/0082478A1 and US 2015/0059010A1 and in International Patent Application PCT/US2015/038767 A1 (published as WO 2016/007347 and claiming priority to U.S. Provisional Patent Application 62/023,246).

CRISPR (Clustered Regularly Interspaced Short Palindromic Repeats)/Cas (CRISPR-associated) systems, or CRISPR systems, are adaptive defense systems originally discovered in bacteria and archaea. CRISPR systems use RNA-guided nucleases termed CRISPR-associated or "Cas" endonucleases (e. g., Cas9 or Cpf1) to cleave foreign DNA. In a typical CRISPR/Cas system, a Cas endonuclease is directed to a target nucleotide sequence (e. g., a site in the genome that is to be sequence-edited) by sequence-specific, non-coding "guide RNAs" that target single- or double-stranded DNA sequences. In microbial hosts, CRISPR loci encode both Cas endonucleases and "CRISPR arrays" of the non-coding RNA elements that determine the specificity of the CRISPR-mediated nucleic acid cleavage.

Three classes (I-III) of CRISPR systems have been identified across a wide range of bacterial hosts. The well characterized class II CRISPR systems use a single Cas endonuclease (rather than multiple Cas proteins). One class II CRISPR system includes a type II Cas endonuclease such as Cas9, a CRISPR RNA ("crRNA"), and a trans-activating crRNA ("tracrRNA"). The crRNA contains a "guide RNA", typically a 20-nucleotide RNA sequence that corresponds to (i. e., is identical or nearly identical to, or alternatively is complementary or nearly complementary to) a 20-nucleotide target DNA sequence. The crRNA also contains a region that binds to the tracrRNA to form a partially double-stranded structure which is cleaved by RNase III, resulting in a crRNA/tracrRNA hybrid. The crRNA/tracrRNA hybrid then directs the Cas9 endonuclease to recognize and cleave the target DNA sequence.

The target DNA sequence must generally be adjacent to a "protospacer adjacent motif" ("PAM") that is specific for a given Cas endonuclease; however, PAM sequences are short and relatively non-specific, appearing throughout a given genome. CRISPR endonucleases identified from various prokaryotic species have unique PAM sequence requirements; examples of PAM sequences include 5'-NGG (*Streptococcus pyogenes*), 5'-NNAGAA (*Streptococcus thermophilus* CRISPR1), 5'-NGGNG (*Streptococcus thermophilus* CRISPR3), 5'-NNGRRT or 5'-NNGRR (*Staphylococcus aureus* Cas9, SaCas9), and 5'-NNNGATT (*Neisseria meningitidis*). Some endonucleases, e. g., Cas9 endonucleases, are associated with G-rich PAM sites, e. g., 5'-NGG, and perform blunt-end cleaving of the target DNA at a location 3 nucleotides upstream from (5' from) the PAM site.

Another class II CRISPR system includes the type V endonuclease Cpf1, which is a smaller endonuclease than is Cas9; examples include AsCpf1 (from *Acidaminococcus* sp.) and LbCpf1 (from *Lachnospiraceae* sp.). Cpf1-associated CRISPR arrays are processed into mature crRNAs without the requirement of a tracrRNA; in other words, a Cpf1 system requires only the Cpf1 nuclease and a crRNA to cleave the target DNA sequence. Cpf1 endonucleases, are associated with T-rich PAM sites, e. g., 5'-TTN. Cpf1 can also recognize a 5'-CTA PAM motif. Cpf1 cleaves the target DNA by introducing an offset or staggered double-strand break with a 4- or 5-nucleotide 5' overhang, for example, cleaving a target DNA with a 5-nucleotide offset or staggered cut located 18 nucleotides downstream from (3' from) from the PAM site on the coding strand and 23 nucleotides downstream from the PAM site on the complimentary strand; the 5-nucleotide overhang that results from such offset cleavage allows more precise genome editing by DNA insertion by homologous recombination than by insertion at blunt-end cleaved DNA. See, e. g., Zetsche et al. (2015) *Cell*, 163:759-771. Other CRISPR nucleases useful in methods and compositions of the invention include C2c1 and C2c3 (see Shmakov et al. (2015) *Mol. Cell*, 60:385-397). Like other CRISPR nucleases, C2c1 from *Alicyclobacillus acidoterrestris* (AacC2c1; amino acid sequence with accession ID TOD7A2, deposited on-line at www[dot]ncbi[dot]nlm[dot]nih[dot]gov/protein/1076761101) requires a guide RNA and PAM recognition site; C2c1 cleavage results in a staggered seven-nucleotide DSB in the target DNA (see Yang et al. (2016) *Cell*, 167:1814-1828.e12) and is reported to have high mismatch sensitivity, thus reducing off-target effects (see Liu et al. (2016) *Mol. Cell*, available on line at dx[dot]doi[dot]org/10[dot]1016/j[dot]molcel[dot]2016[dot]11.040). Yet other CRISPR nucleases include nucleases identified from the genomes of uncultivated microbes, such as CasX and CasY (e. g., a CRISPR-associated protein CasY from an uncultured Parcubacteria group bacterium, amino acid sequence with accession ID APG80656, deposited on-line at www[dot]ncbi[dot]nlm[dot]nih[dot]gov/protein/APG80656.1]); see Burstein et al. (2016) *Nature*, doi: 10.1038/nature21059.

For the purposes of gene editing, CRISPR arrays can be designed to contain one or multiple guide RNA sequences corresponding to a desired target DNA sequence; see, for example, Cong et al. (2013) *Science*, 339:819-823; Ran et al. (2013) *Nature Protocols*, 8:2281-2308. At least 16 or 17 nucleotides of gRNA sequence are required by Cas9 for DNA cleavage to occur; for Cpf1 at least 16 nucleotides of gRNA sequence are needed to achieve detectable DNA cleavage and at least 18 nucleotides of gRNA sequence were reported necessary for efficient DNA cleavage in vitro; see Zetsche et al. (2015) *Cell*, 163:759-771. In practice, guide RNA sequences are generally designed to have a length of between 17-24 nucleotides (frequently 19, 20, or 21 nucleotides) and exact complementarity (i. e., perfect base-pairing) to the targeted gene or nucleic acid sequence; guide RNAs having less than 100% complementarity to the target sequence can be used (e. g., a gRNA with a length of 20 nucleotides and between 1-4 mismatches to the target sequence) but can increase the potential for off-target effects. The design of effective guide RNAs for use in plant genome editing is disclosed in U. S. Patent Application Publication 2015/0082478 A1, the entire specification of which is incorporated herein by reference. More recently, efficient gene editing has been achieved using a chimeric "single guide RNA" ("sgRNA"), an engineered (synthetic) single RNA molecule that mimics a naturally occurring crRNA-tracrRNA complex and contains both a tracrRNA (for binding the nuclease) and at least one crRNA (to guide the nuclease to the sequence targeted for editing); see, for example, Cong et al. (2013) *Science*, 339:819-823; Xing et al. (2014) *BMC Plant Biol.*, 14:327-340. Chemically modified sgRNAs have been demonstrated to be effective in genome editing; see, for example, Hendel et al. (2015) *Nature Biotech.*, 985-991.

CRISPR-type genome editing has value in various aspects of agriculture research and development. CRISPR elements, i.e., CRISPR endonucleases and CRISPR single-guide RNAs, are useful in effecting genome editing without remnants of the CRISPR elements or selective genetic markers occurring in progeny. Alternatively, genome-inserted CRISPR elements are useful in plant lines adapted for multiplex genetic screening and breeding. For instance, a plant species can be created to express one or more of a CRISPR endonuclease such as a Cas9- or a Cpf1-type endonuclease or combinations with unique PAM recognition sites. Cpf1 endonuclease and corresponding guide RNAs and PAM sites are disclosed in U. S. Patent Application Publication 2016/0208243 A1, which is incorporated herein by reference for its disclosure of DNA encoding Cpf1 endonucleases and guide RNAs and PAM sites. Introduction of one or more of a wide variety of CRISPR guide RNAs that interact with CRISPR endonucleases integrated into a plant genome or otherwise provided to a plant is useful for genetic editing for providing desired phenotypes or traits, for trait screening, or for trait introgression. Multiple endonucleases can be provided in expression cassettes with the appropriate promoters to allow multiple genome editing in a spatially or temporally separated fashion in either in chromosome DNA or episome DNA.

Whereas wild-type Cas9 generates double-strand breaks (DSBs) at specific DNA sequences targeted by a gRNA, a number of CRISPR endonucleases having modified functionalities are available, for example: (1) a "nickase" version of Cas9 generates only a single-strand break; (2) a catalytically inactive Cas9 ("dCas9") does not cut the target DNA but interferes with transcription; (3) dCas9 on its own or fused to a repressor peptide can repress gene expression; (4) dCas9 fused to an activator peptide can activate or increase gene expression; (5) dCas9 fused to FokI nuclease ("dCas9-FokI") can be used to generate DSBs at target sequences homologous to two gRNAs; and (6) dCas9 fused to histone-modifying enzymes (e. g., histone acetyltransferases, histone methyltransferases, histone deacetylases, and histone demethylases) can be used to alter the epigenome in a site-specific manner, for example, by changing the methylation or acetylation status at a particular locus. See, e. g., the numerous CRISPR/Cas9 plasmids disclosed in and publicly available from the Addgene repository (Addgene, 75 Sidney St., Suite 550A, Cambridge, MA 02139; addgene[dot]org/crispr/). A "double nickase" Cas9 that introduces two separate double-strand breaks, each directed by a separate guide RNA, is described as achieving more accurate genome editing by Ran et al. (2013) *Cell*, 154:1380-1389.

In some embodiments, the methods of targeted modification described herein provide a means for avoiding unwanted epigenetic losses that can arise from tissue culturing modified plant cells (see, e.g., Stroud et al. *eLife* 2013; 2:e00354). Using the methods described herein in the absence of tissue culture, a loss of epigenetic marking may occur in less than 0.01% of the genome. This contrasts with results obtained with tomato plants where tissue culture methods may result in losses of DNA methylation that occur, on average, as determined by bisulfite sequencing, at 1344 places that are on average 334 base pairs long, which means a loss of DNA methylation at an average of 0.1% of the genome (Stroud, 2013). In other words, the loss in marks using the targeted modification techniques described herein without tissue culture is 10 times lower than the loss observed when tissue culture techniques are relied on. In certain embodiments of the novel modified plant cells described herein, the modified plant cell or plant does not have significant losses of methylation compared to a non-modified parent plant cell or plant; in other words, the methylation pattern of the genome of the modified plant cell or plant is not greatly different from the methylation pattern of the genome of the parent plant cell or plant; in embodiments, the difference between the methylation pattern of the genome of the modified plant cell or plant and that of the parent plant cell or plant is less than 0.1%, 0.05%, 0.02%, or 0.01% of the genome, or less than 0.005% of the genome, or less than 0.001% of the genome (see, e. g., Stroud et al. (2013) eLife 2:e00354; doi: 10.7554/eLife.00354).

CRISPR technology for editing the genes of eukaryotes is disclosed in U.S. Patent Application Publications 2016/0138008A1 and US2015/0344912A1, and in U.S. Pat. Nos. 8,697,359, 8,771,945, 8,945,839, 8,999,641, 8,993,233, 8,895,308, 8,865,406, 8,889,418, 8,871,445, 8,889,356, 8,932,814, 8,795,965, and 8,906,616. Cpf1 endonuclease and corresponding guide RNAs and PAM sites are disclosed in U.S. Patent Application Publication 2016/0208243 A1. Plant RNA promoters for expressing CRISPR guide RNA and plant codon-optimized CRISPR Cas9 endonuclease are disclosed in International Patent Application PCT/US2015/018104 (published as WO 2015/131101 and claiming priority to U.S. Provisional Patent Application 61/945,700). Methods of using CRISPR technology for genome editing in plants are disclosed in in U.S. Patent Application Publications US 2015/0082478A1 and US 2015/0059010A1 and in International Patent Application PCT/US2015/038767 A1 (published as WO 2016/007347 and claiming priority to U.S. Provisional Patent Application 62/023,246). All of the patent publications referenced in this paragraph are incorporated herein by reference in their entirety.

In some embodiments, one or more vectors driving expression of one or more polynucleotides encoding elements of a genome-editing system (e. g., encoding a guide RNA or a nuclease) are introduced into a plant cell or a plant protoplast, whereby these elements, when expressed, result in alteration of a target nucleotide sequence. In embodiments, a vector comprises a regulatory element such as a promoter operably linked to one or more polynucleotides encoding elements of a genome-editing system. In such embodiments, expression of these polynucleotides can be controlled by selection of the appropriate promoter, particularly promoters functional in a plant cell; useful promoters include constitutive, conditional, inducible, and temporally or spatially specific promoters (e. g., a tissue specific promoter, a developmentally regulated promoter, or a cell cycle regulated promoter). In embodiments, the promoter is operably linked to nucleotide sequences encoding multiple guide RNAs, wherein the sequences encoding guide RNAs are separated by a cleavage site such as a nucleotide sequence encoding a microRNA recognition/cleavage site or a self-cleaving ribozyme (see, e. g., Ferr6-D'Amard and Scott (2014) *Cold Spring Harbor Perspectives Biol.,* 2:a003574). In embodiments, the promoter is a pol II promoter operably linked to a nucleotide sequence encoding one or more guide RNAs. In embodiments, the promoter operably linked to one or more polynucleotides encoding elements of a genome-editing system is a constitutive promoter that drives DNA expression in plant cells; in embodiments, the promoter drives DNA expression in the nucleus or in an organelle such as a chloroplast or mitochondrion. Examples of constitutive promoters include a CaMV 35S promoter as disclosed in U.S. Pat. Nos. 5,858,742 and 5,322,938, a rice actin promoter as disclosed in U.S. Pat. No. 5,641,876, a maize chloroplast aldolase promoter as disclosed in U.S. Pat. No. 7,151,204, and an opaline synthase (NOS) and octapine synthase (OCS) promoter from *Agrobacterium tumefaciens*. In embodiments, the promoter operably linked to one or more polynucleotides encoding elements of a genome-editing system is a promoter from figwort mosaic virus (FMV), a RUBISCO promoter, or a pyruvate phosphate dikinase (PDK) promoter, which is active in the chloroplasts of mesophyll cells. Other contemplated promoters include cell-specific or tissue-specific or developmentally regulated promoters, for example, a promoter that limits the expression of the nucleic acid targeting system to germline or reproductive cells (e. g., promoters of genes encoding DNA ligases, recombinases, replicases, or other genes specifically expressed in germline or reproductive cells); in such embodiments, the nuclease-mediated genetic modification (e. g., chromosomal or episomal double-stranded DNA cleavage) is limited only those cells from which DNA is inherited in subsequent generations, which is advantageous where it is desirable that expression of the genome-editing system be limited in order to avoid genotoxicity or other unwanted effects. All of the patent publications referenced in this paragraph are incorporated herein by reference in their entirety.

In some embodiments, elements of a genome-editing system (e.g., an RNA-guided nuclease and a guide RNA) are operably linked to separate regulatory elements on separate vectors. In other embodiments, two or more elements of a genome-editing system expressed from the same or different regulatory elements or promoters are combined in a single vector, optionally with one or more additional vectors providing any additional necessary elements of a genome-editing system not included in the first vector. For example, multiple guide RNAs can be expressed from one vector, with the appropriate RNA-guided nuclease expressed from a second vector. In another example, one or more vectors for the expression of one or more guide RNAs (e. g., crRNAs or sgRNAs) are delivered to a cell (e. g., a plant cell or a plant protoplast) that expresses the appropriate RNA-guided nuclease, or to a cell that otherwise contains the nuclease, such as by way of prior administration thereto of a vector for in vivo expression of the nuclease.

Genome-editing system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In embodiments, the endonuclease and the nucleic acid-targeting guide RNA may be operably linked to and expressed from the same promoter. In embodiments, a single promoter drives expression of a transcript encoding an endonuclease and the guide RNA, embedded within one or more intron sequences (e. g., each in a different intron, two or more in at least one intron, or all in a single intron), which can be plant-derived; such use of introns is especially contemplated when the expression vector is being transformed or transfected into a monocot plant cell or a monocot plant protoplast.

Expression vectors provided herein may contain a DNA segment near the 3' end of an expression cassette that acts as a signal to terminate transcription and directs polyadenylation of the resultant mRNA. Such a 3' element is commonly referred to as a "3'-untranslated region" or "3'-UTR" or a "polyadenylation signal". Useful 3' elements include: *Agrobacterium tumefaciens* nos 3', tml 3', tmr 3', tms 3', ocs 3', and tr7 3' elements disclosed in U.S. Pat. No. 6,090,627, incorporated herein by reference, and 3' elements from plant genes such as the heat shock protein 17, ubiquitin, and fructose-1,6-bisphosphatase genes from wheat (*Triticum aestivum*), and the glutelin, lactate dehydrogenase, and beta-tubulin genes from rice (*Oryza sativa*), disclosed in U. S. Patent Application Publication 2002/0192813 A1, incorporated herein by reference.

In certain embodiments, a vector or an expression cassette includes additional components, e. g., a polynucleotide encoding a drug resistance or herbicide gene or a polynucleotide encoding a detectable marker such as green fluorescent protein (GFP) or beta-glucuronidase (gus) to allow convenient screening or selection of cells expressing the vector. In embodiments, the vector or expression cassette includes additional elements for improving delivery to a plant cell or plant protoplast or for directing or modifying expression of one or more genome-editing system elements, for example, fusing a sequence encoding a cell-penetrating peptide, localization signal, transit, or targeting peptide to the RNA-guided nuclease, or adding a nucleotide sequence to stabilize a guide RNA; such fusion proteins (and the polypeptides encoding such fusion proteins) or combination polypeptides, as well as expression cassettes and vectors for their expression in a cell, are specifically claimed. In embodiments, an RNA-guided nuclease (e. g., Cas9, Cpf1, CasY, CasX, C2c1, or C2c3) is fused to a localization signal, transit, or targeting peptide, e. g., a nuclear localization signal (NLS), a chloroplast transit peptide (CTP), or a mitochondrial targeting peptide (MTP); in a vector or an expression cassette, the nucleotide sequence encoding any of these can be located either 5' and/or 3' to the DNA encoding the nuclease. For example, a plant-codon-optimized Cas9 (pco-Cas9) from *Streptococcus pyogenes* and *S. thermophilus* containing nuclear localization signals and codon-optimized for expression in maize is disclosed in PCT/US2015/018104 (published as WO/2015/131101 and claiming priority to U.S. Provisional Patent Application 61/945,700), incorporated herein by reference. In another example, a chloroplast-targeting RNA is appended to the 5' end of an mRNA encoding an endonuclease to drive the accumulation of the mRNA in chloroplasts; see Gomez, et al. (2010) *Plant Signal Behav.,* 5: 1517-1519. In an embodiment, a Cas9 from *Streptococcus pyogenes* is fused to a nuclear localization signal (NLS), such as the NLS from SV40. In an embodiment, a Cas9 from *Streptococcus pyogenes* is fused to a cell-penetrating peptide (CPP), such as octa-arginine or nona-arginine or a homoarginine 12-mer oligopeptide, or a CPP disclosed in the database of cell-penetrating peptides CPPsite 2.0, publicly available at crdd[dot]osdd[dot]net/raghava/cppsite/. In an example, a Cas9 from *Streptococcus pyogenes* (which normally carries a net positive charge) is modified at the N-terminus with a negatively charged glutamate peptide "tag" and at the C-terminus with a nuclear localization signal (NLS); when mixed with cationic arginine gold nanoparticles (ArgNPs), self-assembled nanoassemblies were formed which were shown to provide good editing efficiency in human cells; see Mout et al. (2017) *ACS Nano,* doi:10.1021/acsnano.6b07600. In an embodiment, a Cas9 from *Streptococcus pyogenes* is fused to a chloroplast transit peptide (CTP) sequence. In embodiments, a CTP sequence is obtained from any nuclear gene that encodes a protein that targets a chloroplast, and the isolated or synthesized CTP DNA is appended to the 5' end of the DNA that encodes a nuclease targeted for use in a chloroplast. Chloroplast transit peptides and their use are described in U.S. Pat. Nos. 5,188,642, 5,728,925, and 8,420,888, all of which are incorporated herein by reference in their entirety. Specifically, the CTP nucleotide sequences provided with the sequence identifier (SEQ ID) numbers 12-15 and 17-22 of U.S. Pat. No. 8,420,888 are incorporated herein by reference. In an embodiment, a Cas9 from *Streptococcus pyogenes* is fused to a mitochondrial targeting peptide (MTP), such as a plant MTP sequence; see, e. g., Jores et al. (2016) *Nature Communications,* 7:12036-12051.

Plasmids designed for use in plants and encoding CRISPR genome editing elements (CRISPR nucleases and guide RNAs) are publicly available from plasmid repositories such as Addgene (Cambridge, Massachusetts; also see "addgene [dot]com") or can be designed using publicly disclosed sequences, e. g., sequences of CRISPR nucleases. In embodiments, such plasmids are used to co-express both CRISPR nuclease mRNA and guide RNA(s); in other embodiments, CRISPR endonuclease mRNA and guide RNA are encoded on separate plasmids. In embodiments, the plasmids are *Agrobacterium* TI plasmids. Materials and methods for preparing expression cassettes and vectors for CRISPR endonuclease and guide RNA for stably integrated and/or transient plant transformation are disclosed in PCT/US2015/018104 (published as WO/2015/131101 and claiming priority to U.S. Provisional Patent Application 61/945,700), U. S. Patent Application Publication 2015/0082478 A1, and PCT/US2015/038767 (published as WO/2016/007347 and claiming priority to U.S. Provisional Patent Application 62/023,246), all of which are incorporated herein by reference in their entirety. In embodiments, such expression cassettes are isolated linear fragments, or are part of a larger construct that includes bacterial replication elements and selectable markers; such embodiments are useful, e. g., for particle bombardment or nanoparticle delivery or protoplast transformation. In embodiments, the expression cassette is adjacent to or located between T-DNA borders or contained within a binary vector, e. g., for *Agrobacterium*-mediated transformation. In embodiments, a plasmid encoding a CRISPR nuclease is delivered to cell (such as a plant cell or a plant protoplast) for stable integration of the CRISPR nuclease into the genome of cell, or alternatively for transient expression of the CRISPR nuclease. In embodiments, plasmids encoding a CRISPR nuclease are delivered to a plant cell or a plant protoplast to achieve stable or transient expression of the CRISPR nuclease, and one or multiple guide RNAs (such as a library of individual guide RNAs or multiple pooled guide RNAs) or plasmids encoding the guide RNAs are delivered to the plant cell or plant protoplast individually or in combinations, thus providing libraries or arrays of plant cells or plant protoplasts (or of plant callus or whole plants derived therefrom), in which a variety of genome edits are provided by the different guide RNAs. A pool or arrayed collection of diverse modified plant cells comprising subsets of targeted modifications (e.g., a collection of plant cells or plants where some plants are homozygous and some are heterozygous for one, two, three or more targeted modifications) can be compared to determine the function of modified sequences (e.g., mutated or deleted sequences or genes) or the function of sequences being inserted. In other words, the methods and tools described herein can be used to perform "reverse genetics."

In certain embodiments where the genome-editing system is a CRISPR system, expression of the guide RNA is driven by a plant U6 spliceosomal RNA promoter, which can be native to the genome of the plant cell or from a different species, e. g., a U6 promoter from maize, tomato, or soybean such as those disclosed in PCT/US2015/018104 (published as WO 2015/131101 and claiming priority to U.S. Provisional Patent Application 61/945,700), incorporated herein by reference, or a homologue thereof, such a promoter is operably linked to DNA encoding the guide RNA for directing an endonuclease, followed by a suitable 3' element such as a U6 poly-T terminator. In another embodiment, an expression cassette for expressing guide RNAs in plants is used, wherein the promoter is a plant U3, 7SL (signal recognition particle RNA), U2, or U5 promoter, or chimerics thereof, e. g., as described in PCT/US2015/018104 (published as WO 2015/131101 and claiming priority to U.S. Provisional Patent Application 61/945,700), incorporated herein by reference. When multiple or different guide RNA sequences are used, a single expression construct may be used to correspondingly direct the genome editing activity to the multiple or different target sequences in a cell, such a plant cell or a plant protoplast. In various embodiments, a single vector includes 1, 2, 3, 4, 5, 6, 7, 8, 9, 10, about 15, about 20, or more guide RNA sequences; in other embodiments, 1, 2, 3, 4, 5, 6, 7, 8, 9, 10, about 15, about 20, or more guide RNA sequences are provided on multiple vectors, which can be delivered to one or multiple plant cells or plant protoplasts (e. g., delivered to an array of plant cells or plant protoplasts, or to a pooled population of plant cells or plant protoplasts).

In embodiments, one or more guide RNAs and the corresponding RNA-guided nuclease are delivered together or simultaneously. In other embodiments, one or more guide RNAs and the corresponding RNA-guided nuclease are delivered separately; these can be delivered in separate, discrete steps and using the same or different delivery techniques. In an example, an RNA-guided nuclease is delivered to a cell (such as a plant cell or plant protoplast) by particle bombardment, on carbon nanotubes, or by *Agrobacterium*-mediated transformation, and one or more guide RNAs is delivered to the cell in a separate step using the same or different delivery technique. In embodiments, an RNA-guided nuclease encoded by a DNA molecule or an mRNA is delivered to a cell with enough time prior to delivery of the guide RNA to permit expression of the nuclease in the cell; for example, an RNA-guided nuclease encoded by a DNA molecule or an mRNA is delivered to a plant cell or plant protoplast between 1-12 hours (e. g., about 1, 2, 3, 4, 5, 6, 7, 8, 9, 10, 11, or 12 hours, or between about 1-6 hours or between about 2-6 hours) prior to the delivery of the guide RNA to the plant cell or plant protoplast. In embodiments, whether the RNA-guided nuclease is delivered simultaneously with or separately from an initial dose of guide RNA, succeeding "booster" doses of guide RNA are delivered subsequent to the delivery of the initial dose; for example, a second "booster" dose of guide RNA is delivered to a plant cell or plant protoplast between 1-12 hours (e. g., about 1, 2, 3, 4, 5, 6, 7, 8, 9, 10, 11, or 12 hours, or between about 1-6 hours or between about 2-6 hours) subsequent to the delivery of the initial dose of guide RNA to the plant cell or plant protoplast. Similarly, in some embodiments, multiple deliveries of an RNA-guided nuclease or of a DNA molecule or an mRNA encoding an RNA-guided nuclease are used to increase efficiency of the genome modification.

In embodiments, the desired genome modification involves non-homologous recombination, in this case non-homologous end-joining of genomic sequence across one or more introduced double-strand breaks; generally, such embodiments do not require a donor template having homology "arms" (regions of homologous or complimentary sequence to genomic sequence flanking the site of the DSB). In various embodiments described herein, donor polynucleotides encoding sequences for targeted insertion at double-stranded breaks are single-stranded polynucleotides comprising RNA or DNA or both types of nucleotides; or the donor polynucleotides are at least partially double-stranded and comprise RNA, DNA or both types of nucleotides. Other modified nucleotides may also be used.

In other embodiments, the desired genome modification involves homologous recombination, wherein one or more double-stranded DNA break in the target nucleotide sequence is generated by the RNA-guided nuclease and guide RNA(s), followed by repair of the break(s) using a homologous recombination mechanism ("homology-directed repair"). In such embodiments, a donor template that encodes the desired nucleotide sequence to be inserted or knocked-in at the double-stranded break and generally having homology "arms" (regions of homologous or complimentary sequence to genomic sequence flanking the site of the DSB) is provided to the cell (such as a plant cell or plant protoplast); examples of suitable templates include single-stranded DNA templates and double-stranded DNA templates (e. g., in the form of a plasmid). In general, a donor template encoding a nucleotide change over a region of less than about 50 nucleotides is conveniently provided in the form of single-stranded DNA; larger donor templates (e. g., more than 100 nucleotides) are often conveniently provided as double-stranded DNA plasmids.

In certain embodiments directed to the targeted incorporation of sequences by homologous recombination, a donor template has a core nucleotide sequence that differs from the target nucleotide sequence (e. g., a homologous endogenous genomic region) by at least 1, at least 5, at least 10, at least 20, at least 30, at least 40, at least 50, or more nucleotides. This core sequence is flanked by "homology arms" or regions of high sequence identity with the targeted nucleotide sequence; in embodiments, the regions of high identity include at least 10, at least 50, at least 100, at least 150, at least 200, at least 300, at least 400, at least 500, at least 600, at least 750, or at least 1000 nucleotides on each side of the core sequence. In embodiments where the donor template is in the form of a single-stranded DNA, the core sequence is flanked by homology arms including at least 10, at least 20, at least 30, at least 40, at least 50, at least 60, at least 70, at least 80, or at least 100 nucleotides on each side of the core sequence. In embodiments where the donor template is in the form of a double-stranded DNA plasmid, the core sequence is flanked by homology arms including at least 500, at least 600, at least 700, at least 800, at least 900, or at least 1000 nucleotides on each side of the core sequence. In an embodiment, two separate double-strand breaks are introduced into the cell's target nucleotide sequence with a "double nickase" Cas9 (see Ran et al. (2013) *Cell*, 154: 1380-1389), followed by delivery of the donor template.

Delivery Methods and Agents

Aspects of the invention involve various treatments employed to deliver to a plant cell or protoplast a guide RNA (gRNA), such as a crRNA or sgRNA (or a polynucleotide encoding such), and/or a polynucleotide encoding a sequence for targeted insertion at a double-strand break in a genome. In embodiments, one or more treatments are employed to deliver the gRNA into a plant cell or plant protoplast, e. g., through barriers such as a cell wall or a plasma membrane or nuclear envelope or other lipid bilayer.

Unless otherwise stated, the various compositions and methods described herein for delivering guide RNAs and nucleases to a plant cell or protoplast are also generally useful for delivering donor polynucleotides to the cell. The delivery of donor polynucleotides can be simultaneous with, or separate from (generally after) delivery of the nuclease and guide RNA to the cell. For example, a donor polynucleotide can be transiently introduced into a plant cell or plant protoplast, optionally with the nuclease and/or gRNA; in certain embodiments, the donor template is provided to the plant cell or plant protoplast in a quantity that is sufficient to achieve the desired insertion of the donor polynucleotide sequence but donor polynucleotides do not persist in the plant cell or plant protoplast after a given period of time (e. g., after one or more cell division cycles).

In certain embodiments, a gRNA- or donor polynucleotide, in addition to other agents involved in targeted modifications, can be delivered to a plant cell or protoplast by directly contacting the plant cell or protoplast with a composition comprising the gRNA(s) or donor polynucleotide(s). For example, a gRNA-containing composition in the form of a liquid, a solution, a suspension, an emulsion, a reverse emulsion, a colloid, a dispersion, a gel, liposomes, micelles, an injectable material, an aerosol, a solid, a powder, a particulate, a nanoparticle, or a combination thereof can be applied directly to a plant cell (or plant part or tissue containing the plant cell) or plant protoplast (e. g., through abrasion or puncture or otherwise disruption of the cell wall or cell membrane, by spraying or dipping or soaking or otherwise directly contacting, or by microinjection). In certain embodiments, a plant cell (or plant part or tissue containing the plant cell) or plant protoplast is soaked in a liquid gRNA-containing composition, whereby the gRNA is delivered to the plant cell or plant protoplast. In embodiments, the gRNA-containing composition is delivered using negative or positive pressure, for example, using vacuum infiltration or application of hydrodynamic or fluid pressure. In embodiments, the gRNA-containing composition is introduced into a plant cell or plant protoplast, e. g., by microinjection or by disruption or deformation of the cell wall or cell membrane, for example by physical treatments such as by application of negative or positive pressure, shear forces, or treatment with a chemical or physical delivery agent such as surfactants, liposomes, or nanoparticles; see, e. g., delivery of materials to cells employing microfluidic flow through a cell-deforming constriction as described in US Published Patent Application 2014/0287509, incorporated by reference in its entirety herein. Other techniques useful for delivering the gRNA-containing composition to a plant cell or plant protoplast include: ultrasound or sonication; vibration, friction, shear stress, vortexing, cavitation; centrifugation or application of mechanical force; mechanical cell wall or cell membrane deformation or breakage; enzymatic cell wall or cell membrane breakage or permeabilization; abrasion or mechanical scarification (e. g., abrasion with carborundum or other particulate abrasive or scarification with a file or sandpaper) or chemical scarification (e. g., treatment with an acid or caustic agent); and electroporation. In embodiments, the gRNA-containing composition is provided by bacterially mediated (e. g., *Agrobacterium* sp., *Rhizobium* sp., *Sinorhizobium* sp., *Mesorhizobium* sp., *Bradyrhizobium* sp., *Azobacter* sp., *Phyllobacterium* sp.) transfection of the plant cell or plant protoplast with a polynucleotide encoding the gRNA; see, e. g., Broothaerts et al. (2005) *Nature*, 433:629-633. Any of these techniques or a combination thereof are alternatively employed on the plant part or tissue or intact plant (or seed) from which a plant cell or plant protoplast is optionally subsequently obtained or isolated; in embodiments, the gRNA-containing composition is delivered in a separate step after the plant cell or plant protoplast has been obtained or isolated.

In embodiments, a treatment employed in delivery of a gRNA to a plant cell or plant protoplast is carried out under a specific thermal regime, which can involve one or more appropriate temperatures, e. g., chilling or cold stress (exposure to temperatures below that at which normal plant growth occurs), or heating or heat stress (exposure to temperatures above that at which normal plant growth occurs), or treating at a combination of different temperatures. In embodiments, a specific thermal regime is carried out on the plant cell or plant protoplast, or on a plant or plant part from which a plant cell or plant protoplast is subsequently obtained or isolated, in one or more steps separate from the gRNA delivery.

In embodiments, a whole plant or plant part or seed, or an isolated plant cell or plant protoplast, or the plant or plant part from which a plant cell or plant protoplast is obtained or isolated, is treated with one or more delivery agents which can include at least one chemical, enzymatic, or physical agent, or a combination thereof. In embodiments, a gRNA-containing composition further includes one or more one chemical, enzymatic, or physical agent for delivery. In embodiments that further include the step of providing an RNA-guided nuclease or a polynucleotide that encodes the RNA-guided nuclease, a gRNA-containing composition including the RNA-guided nuclease or polynucleotide that encodes the RNA-guided nuclease further includes one or more one chemical, enzymatic, or physical agent for delivery. Treatment with the chemical, enzymatic or physical agent can be carried out simultaneously with the gRNA delivery, with the RNA-guided nuclease delivery, or in one or more separate steps that precede or follow the gRNA delivery or the RNA-guided nuclease delivery. In embodiments, a chemical, enzymatic, or physical agent, or a combination of these, is associated or complexed with the polynucleotide composition, with the gRNA or polynucleotide that encodes or is processed to the gRNA, or with the RNA-guided nuclease or polynucleotide that encodes the RNA-guided nuclease; examples of such associations or complexes include those involving non-covalent interactions (e. g., ionic or electrostatic interactions, hydrophobic or hydrophilic interactions, formation of liposomes, micelles, or other heterogeneous composition) and covalent interactions (e. g., peptide bonds, bonds formed using cross-linking agents). In non-limiting examples, a gRNA or polynucleotide that encodes or is processed to the gRNA is provided as a liposomal complex with a cationic lipid; a gRNA or polynucleotide that encodes or is processed to the gRNA is provided as a complex with a carbon nanotube; and an RNA-guided nuclease is provided as a fusion protein between the nuclease and a cell-penetrating peptide. Examples of agents useful for delivering a gRNA or polynucleotide that encodes or is processed to the gRNA or a nuclease or polynucleotide that encodes the nuclease include the various cationic liposomes and polymer nanoparticles reviewed by Zhang et al. (2007) *J. Controlled Release*, 123:1-10, and the cross-linked multilamellar liposomes described in U. S. Patent Application Publication 2014/0356414 A1, incorporated by reference in its entirety herein.

In embodiments, the chemical agent is at least one selected from the group consisting of:
  (a) solvents (e. g., water, dimethylsulfoxide, dimethylformamide, acetonitrile, N-pyrrolidine, pyridine, hexamethylphosphoramide, alcohols, alkanes, alkenes, dioxanes, polyethylene glycol, and other solvents miscible or emulsifiable with water or that will dissolve phosphonucleotides in non-aqueous systems);
  (b) fluorocarbons (e. g., perfluorodecalin, perfluoromethyldecalin);
  (c) glycols or polyols (e. g., propylene glycol, polyethylene glycol);

(d) surfactants, including cationic surfactants, anionic surfactants, non-ionic surfactants, and amphiphilic surfactants, e. g., alkyl or aryl sulfates, phosphates, sulfonates, or carboxylates; primary, secondary, or tertiary amines; quaternary ammonium salts; sultaines, betaines; cationic lipids; phospholipids; tallowamine; bile acids such as cholic acid; long chain alcohols; organosilicone surfactants including nonionic organosilicone surfactants such as trisiloxane ethoxylate surfactants or a silicone polyether copolymer such as a copolymer of polyalkylene oxide modified heptamethyl trisiloxane and allyloxypolypropylene glycol methylether (commercially available as SILWET L-77™ brand surfactant having CAS Number 27306-78-1 and EPA Number CAL. REG. NO. 5905-50073-AA, Momentive Performance Materials, Inc., Albany, N.Y.); specific examples of useful surfactants include sodium lauryl sulfate, the Tween series of surfactants, Triton-X100, Triton-X 114, CHAPS and CHAPSO, Tergitol-type NP-40, Nonidet P-40;

(e) lipids, lipoproteins, lipopolysaccharides;

(f) acids, bases, caustic agents;

(g) peptides, proteins, or enzymes (e. g., cellulase, pectolyase, maceroenzyme, pectinase), including cell-penetrating or pore-forming peptides (e. g., (BO100)2K8, Genscript; poly-lysine, poly-arginine, or poly-homoarginine peptides; gamma zein, see U. S. Patent Application publication 2011/0247100, incorporated herein by reference in its entirety; transcription activator of human immunodeficiency virus type 1 ("HIV-1 Tat") and other Tat proteins, see, e. g., www[dot]lifetein[dot]com/Cell_Penetrating_Peptides[dot]html and Jarver (2012) *Mol. Therapy-Nucleic Acids,* 1:e27, 1-17); octa-arginine or nona-arginine; poly-homoarginine (see Unnamalai et al. (2004) *FEBS Letters,* 566: 307-310); see also the database of cell-penetrating peptides CPPsite 2.0 publicly available at crdd[dot]osdd[dot]net/raghava/cppsite/

(h) RNase inhibitors;

(i) cationic branched or linear polymers such as chitosan, poly-lysine, DEAE-dextran, polyvinylpyrrolidone ("PVP"), or polyethylenimine ("PEI", e. g., PEI, branched, MW 25,000, CAS #9002-98-6; PEI, linear, MW 5000, CAS #9002-98-6; PEI linear, MW 2500, CAS #9002-98-6);

(j) dendrimers (see, e. g., U. S. Patent Application Publication 2011/0093982, incorporated herein by reference in its entirety);

(k) counter-ions, amines or polyamines (e. g., spermine, spermidine, putrescine), osmolytes, buffers, and salts (e. g., calcium phosphate, ammonium phosphate);

(l) polynucleotides (e. g., non-specific double-stranded DNA, salmon sperm DNA);

(m) transfection agents (e. g., Lipofectin®, Lipofectamine®, and Oligofectamine®, and Invivofectamine® (all from Thermo Fisher Scientific, Waltham, MA), PepFect (see Ezzat et al. (2011) *Nucleic Acids Res.,* 39:5284-5298), TransIt® transfection reagents (Mirus Bio, LLC, Madison, WI), and poly-lysine, poly-homoarginine, and poly-arginine molecules including octo-arginine and nono-arginine as described in Lu et al. (2010) *J Agric. Food Chem.,* 58:2288-2294);

(n) antibiotics, including non-specific DNA double-strand-break-inducing agents (e. g., phleomycin, bleomycin, talisomycin); and (o) antioxidants (e. g., glutathione, dithiothreitol, ascorbate).

In embodiments, the chemical agent is provided simultaneously with the gRNA (or polynucleotide encoding the gRNA or that is processed to the gRNA), for example, the polynucleotide composition including the gRNA further includes one or more chemical agent. In embodiments, the gRNA or polynucleotide encoding the gRNA or that is processed to the gRNA is covalently or non-covalently linked or complexed with one or more chemical agent; for example, the gRNA or polynucleotide encoding the gRNA or that is processed to the gRNA can be covalently linked to a peptide or protein (e. g., a cell-penetrating peptide or a pore-forming peptide) or non-covalently complexed with cationic lipids, polycations (e. g., polyamines), or cationic polymers (e. g., PEI). In embodiments, the gRNA or polynucleotide encoding the gRNA or that is processed to the gRNA is complexed with one or more chemical agents to form, e. g., a solution, liposome, micelle, emulsion, reverse emulsion, suspension, colloid, or gel.

In embodiments, the physical agent is at least one selected from the group consisting of particles or nanoparticles (e. g., particles or nanoparticles made of materials such as carbon, silicon, silicon carbide, gold, tungsten, polymers, or ceramics) in various size ranges and shapes, magnetic particles or nanoparticles (e. g., silenceMag Magnetotransfection™ agent, OZ Biosciences, San Diego, CA), abrasive or scarifying agents, needles or microneedles, matrices, and grids. In embodiments, particulates and nanoparticulates are useful in delivery of the polynucleotide composition or the nuclease or both. Useful particulates and nanoparticles include those made of metals (e. g., gold, silver, tungsten, iron, cerium), ceramics (e. g., aluminum oxide, silicon carbide, silicon nitride, tungsten carbide), polymers (e. g., polystyrene, polydiacetylene, and poly(3,4-ethylenedioxythiophene) hydrate), semiconductors (e. g., quantum dots), silicon (e. g., silicon carbide), carbon (e. g., graphite, graphene, graphene oxide, or carbon nanosheets, nanocomplexes, or nanotubes), and composites (e. g., polyvinylcarbazole/graphene, polystyrene/graphene, platinum/graphene, palladium/graphene nanocomposites). In embodiments, such particulates and nanoparticulates are further covalently or non-covalently functionalized, or further include modifiers or cross-linked materials such as polymers (e. g., linear or branched polyethylenimine, poly-lysine), polynucleotides (e. g., DNA or RNA), polysaccharides, lipids, polyglycols (e. g., polyethylene glycol, thiolated polyethylene glycol), polypeptides or proteins, and detectable labels (e. g., a fluorophore, an antigen, an antibody, or a quantum dot). In various embodiments, such particulates and nanoparticles are neutral, or carry a positive charge, or carry a negative charge. Embodiments of compositions including particulates include those formulated, e. g., as liquids, colloids, dispersions, suspensions, aerosols, gels, and solids. Embodiments include nanoparticles affixed to a surface or support, e. g., an array of carbon nanotubes vertically aligned on a silicon or copper wafer substrate. Embodiments include polynucleotide compositions including particulates (e. g., gold or tungsten or magnetic particles) delivered by a Biolistic-type technique or with magnetic force. The size of the particles used in Biolistics is generally in the "microparticle" range, for example, gold microcarriers in the 0.6, 1.0, and 1.6 micrometer size ranges (see, e. g., instruction manual for the Helios® Gene Gun System, Bio-Rad, Hercules, CA; Randolph-Anderson et al. (2015) "Sub-micron gold particles are superior to larger particles for efficient Biolistic® transformation of organelles and some cell types", Bio-Rad US/EG Bulletin 2015), but successful Biolistics delivery using larger (40 nanometer) nanoparticles has been reported in cultured animal cells; see O'Brian and Lummis (2011) *BMC Biotechnol.*, 11:66-71. Other embodiments of useful particulates are nanoparticles, which are generally in the nanometer (nm) size range or less than 1 micrometer, e. g., with a diameter of less than about 1 nm, less than about 3 nm, less than about 5 nm, less than about 10 nm, less than about 20 nm, less than about 40 nm, less than about 60 nm, less than about 80 nm, and less than about 100 nm. Specific, non-limiting embodiments of nanoparticles commercially available (all from Sigma-Aldrich Corp., St. Louis, MO) include gold nanoparticles with diameters of 5, 10, or 15 nm; silver nanoparticles with particle sizes of 10, 20, 40, 60, or 100 nm; palladium "nanopowder" of less than 25 nm particle size; single-, double-, and multi-walled carbon nanotubes, e. g., with diameters of 0.7-1.1, 1.3-2.3, 0.7-0.9, or 0.7-1.3 nm, or with nanotube bundle dimensions of 2-10 nm by 1-5 micrometers, 6-9 nm by 5 micrometers, 7-15 nm by 0.5-10 micrometers, 7-12 nm by 0.5-10 micrometers, 110-170 nm by 5-9 micrometers, 6-13 nm by 2.5-20 micrometers. Embodiments include polynucleotide compositions including materials such as gold, silicon, cerium, or carbon, e. g., gold or gold-coated nanoparticles, silicon carbide whiskers, carborundum, porous silica nanoparticles, gelatin/silica nanoparticles, nanoceria or cerium oxide nanoparticles (CNPs), carbon nanotubes (CNTs) such as single-, double-, or multi-walled carbon nanotubes and their chemically functionalized versions (e. g., carbon nanotubes functionalized with amide, amino, carboxylic acid, sulfonic acid, or polyethylene glycol moeities), and graphene or graphene oxide or graphene complexes; see, for example, Wong et al. (2016) *Nano Lett.*, 16:1161-1172; Giraldo et al. (2014) *Nature Materials*, 13:400-409; Shen et al. (2012) *Theranostics*, 2:283-294; Kim et al. (2011) *Bioconjugate Chem.*, 22:2558-2567; Wang et al. (2010) *J Am. Chem. Soc. Comm.*, 132: 9274-9276; Zhao et al. (2016) *Nanoscale Res. Lett.*, 11:195-203; and Choi et al. (2016) *J Controlled Release*, 235:222-235. See also, for example, the various types of particles and nanoparticles, their preparation, and methods for their use, e. g., in delivering polynucleotides and polypeptides to cells, disclosed in U. S. Patent Application Publications 2010/0311168, 2012/0023619, 2012/0244569, 2013/0145488, 2013/0185823, 2014/0096284, 2015/0040268, 2015/0047074, and 2015/0208663, all of which are incorporated herein by reference in their entirety.

In embodiments wherein the gRNA (or polynucleotide encoding the gRNA) is provided in a composition that further includes an RNA-guided nuclease (or a polynucleotide that encodes the RNA-guided nuclease), or wherein the method further includes the step of providing an RNA-guided nuclease or a polynucleotide that encodes the RNA-guided nuclease, one or more one chemical, enzymatic, or physical agent can similarly be employed. In embodiments, the RNA-guided nuclease (or polynucleotide encoding the RNA-guided nuclease) is provided separately, e. g., in a separate composition including the RNA-guided nuclease or polynucleotide encoding the RNA-guided nuclease. Such compositions can include other chemical or physical agents (e. g., solvents, surfactants, proteins or enzymes, transfection agents, particulates or nanoparticulates), such as those described above as useful in the polynucleotide composition used to provide the gRNA. For example, porous silica nanoparticles are useful for delivering a DNA recombinase into maize cells; see, e. g., Martin-Ortigosa et al. (2015) *Plant Physiol.*, 164:537-547. In an embodiment, the polynucleotide composition includes a gRNA and Cas9 nuclease, and further includes a surfactant and a cell-penetrating peptide. In an embodiment, the polynucleotide composition includes a plasmid that encodes both an RNA-guided nuclease and at least on gRNA, and further includes a surfactant and carbon nanotubes. In an embodiment, the polynucleotide composition includes multiple gRNAs and an mRNA encoding the RNA-guided nuclease, and further includes gold particles, and the polynucleotide composition is delivered to a plant cell or plant protoplast by Biolistics.

In related embodiments, one or more one chemical, enzymatic, or physical agent can be used in one or more steps separate from (preceding or following) that in which the gRNA is provided. In an embodiment, the plant or plant part from which a plant cell or plant protoplast is obtained or isolated is treated with one or more one chemical, enzymatic, or physical agent in the process of obtaining or isolating the plant cell or plant protoplast. In embodiments, the plant or plant part is treated with an abrasive, a caustic agent, a surfactant such as Silwet L-77 or a cationic lipid, or an enzyme such as cellulase.

In embodiments, a gRNA is delivered to plant cells or plant protoplasts prepared or obtained from a plant, plant part, or plant tissue that has been treated with the polynucleotide compositions (and optionally the nuclease). In embodiments, one or more one chemical, enzymatic, or physical agent, separately or in combination with the polynucleotide composition, is provided/applied at a location in the plant or plant part other than the plant location, part, or tissue from which the plant cell or plant protoplast is obtained or isolated. In embodiments, the polynucleotide composition is applied to adjacent or distal cells or tissues and is transported (e. g., through the vascular system or by cell-to-cell movement) to the meristem from which plant cells or plant protoplasts are subsequently isolated. In embodiments, a gRNA-containing composition is applied by soaking a seed or seed fragment or zygotic or somatic embryo in the gRNA-containing composition, whereby the gRNA is delivered to the seed or seed fragment or zygotic or somatic embryo from which plant cells or plant protoplasts are subsequently isolated. In embodiments, a flower bud or shoot tip is contacted with a gRNA-containing composition, whereby the gRNA is delivered to cells in the flower bud or shoot tip from which plant cells or plant protoplasts are subsequently isolated. In embodiments, a gRNA-containing composition is applied to the surface of a plant or of a part of a plant (e. g., a leaf surface), whereby the gRNA is delivered to tissues of the plant from which plant cells or plant protoplasts are subsequently isolated. In embodiments a whole plant or plant tissue is subjected to particle- or nanoparticle-mediated delivery (e. g., Biolistics or carbon nanotube or nanoparticle delivery) of a gRNA-containing composition, whereby the gRNA is delivered to cells or tissues from which plant cells or plant protoplasts are subsequently isolated.

Methods of Modulating Expression of a Sequence of Interest in a Genome

In one aspect, the invention provides a method of changing expression of a sequence of interest in a genome, including integrating a sequence encoded by a polynucleotide (such as a double-stranded DNA, a single-stranded DNA, a single-stranded DNA/RNA hybrid, or a double-stranded DNA/RNA hybrid) donor molecule at the site of at least one double-strand break (DSB) in a genome. The method permits site-specific integration of heterologous sequence at the site of at least one DSB, and thus at one or more locations in a genome, such as a genome of a plant cell.

In embodiments, the genome is that of a nucleus, mitochondrion, or plastid in a plant cell.

By "integration of heterologous sequence" is meant integration or insertion of one or more nucleotides, resulting in a sequence (including the inserted nucleotide(s) as well as at least some adjacent nucleotides of the genomic sequence flanking the site of insertion at the DSB) that is heterologous, i. e., would not otherwise or does not normally occur at the site of insertion. (The term "heterologous" is also used to refer to a given sequence in relationship to another—e. g., the sequence of the polynucleotide donor molecule is heterologous to the sequence at the site of the DSB wherein the polynucleotide is integrated.)

The at least one DSB is introduced into the genome by any suitable technique; in embodiments one or more DSBs is introduced into the genome in a site- or sequence-specific manner, for example, by use of at least one of the group of DSB-inducing agents consisting of: (a) a nuclease capable of effecting site-specific alteration of a target nucleotide sequence, selected from the group consisting of an RNA-guided nuclease, an RNA-guided DNA endonuclease, a type II Cas nuclease, a Cas9, a type V Cas nuclease, a Cpf1, a CasY, a CasX, a C2c1, a C2c3, an engineered nuclease, a codon-optimized nuclease, a zinc-finger nuclease (ZFN), a transcription activator-like effector nuclease (TAL-effector nuclease), an Argonaute, and a meganuclease or engineered meganuclease; (b) a polynucleotide encoding one or more nucleases capable of effecting site-specific alteration (such as introduction of a DSB) of a target nucleotide sequence; and (c) a guide RNA (gRNA) for an RNA-guided nuclease, or a DNA encoding a gRNA for an RNA-guided nuclease. In embodiments, one or more DSBs is introduced into the genome by use of both a guide RNA (gRNA) and the corresponding RNA-guided nuclease. In an example, one or more DSBs is introduced into the genome by use of a ribonucleoprotein (RNP) that includes both a gRNA (e. g., a single-guide RNA or sgRNA that includes both a crRNA and a tracrRNA) and a Cas9. It is generally desirable that the sequence encoded by the polynucleotide donor molecule is integrated at the site of the DSB at high efficiency. One measure of efficiency is the percentage or fraction of the population of cells that have been treated with a DSB-inducing agent and polynucleotide donor molecule, and in which a sequence encoded by the polynucleotide donor molecule is successfully introduced at the DSB correctly located in the genome. The efficiency of genome editing including integration of a sequence encoded by a polynucleotide donor molecule at a DSB in the genome is assessed by any suitable method such as a heteroduplex cleavage assay or by sequencing, as described elsewhere in this disclosure. In various embodiments, the DSB is induced in the correct location in the genome at a comparatively high efficiency, e. g., at about 10, about 15, about 20, about 30, about 40, about 50, about 60, about 70, or about 80 percent efficiency, or at greater than 80, 85, 90, or 95 percent efficiency (measured as the percentage of the total population of cells in which the DSB is induced at the correct location in the genome). In various embodiments, a sequence encoded by the polynucleotide donor molecule is integrated at the site of the DSB at a comparatively high efficiency, e. g., at about 10, about 15, about 20, about 30, about 40, about 50, about 60, about 70, or about 80 percent efficiency, or at greater than 80, 85, 90, or 95 percent efficiency (measured as the percentage of the total population of cells in which the polynucleotide molecule is integrated at the site of the DSB in the correct location in the genome).

Apart from the CRISPR-type nucleases, other nucleases capable of effecting site-specific alteration of a target nucleotide sequence include zinc-finger nucleases (ZFNs), transcription activator-like effector nucleases (TAL-effector nucleases or TALENs), Argonaute proteins, and a meganuclease or engineered meganuclease. Zinc finger nucleases (ZFNs) are engineered proteins comprising a zinc finger DNA-binding domain fused to a nucleic acid cleavage domain, e. g., a nuclease. The zinc finger binding domains provide specificity and can be engineered to specifically recognize any desired target DNA sequence. For a review of the construction and use of ZFNs in plants and other organisms, see, e. g., Urnov et al. (2010) *Nature Rev. Genet.*, 11:636-646. The zinc finger DNA binding domains are derived from the DNA-binding domain of a large class of eukaryotic transcription factors called zinc finger proteins (ZFPs). The DNA-binding domain of ZFPs typically contains a tandem array of at least three zinc "fingers" each recognizing a specific triplet of DNA. A number of strategies can be used to design the binding specificity of the zinc finger binding domain. One approach, termed "modular assembly", relies on the functional autonomy of individual zinc fingers with DNA. In this approach, a given sequence is targeted by identifying zinc fingers for each component triplet in the sequence and linking them into a multifinger peptide. Several alternative strategies for designing zinc finger DNA binding domains have also been developed. These methods are designed to accommodate the ability of zinc fingers to contact neighboring fingers as well as nucleotides bases outside their target triplet. Typically, the engineered zinc finger DNA binding domain has a novel binding specificity, compared to a naturally-occurring zinc finger protein. Modification methods include, for example, rational design and various types of selection. Rational design includes, for example, the use of databases of triplet (or quadruplet) nucleotide sequences and individual zinc finger amino acid sequences, in which each triplet or quadruplet nucleotide sequence is associated with one or more amino acid sequences of zinc fingers which bind the particular triplet or quadruplet sequence. See, e. g., U.S. Pat. Nos. 6,453,242 and 6,534,261, both incorporated herein by reference in their entirety. Exemplary selection methods (e. g., phage display and yeast two-hybrid systems) are well known and described in the literature. In addition, enhancement of binding specificity for zinc finger binding domains has been described in U.S. Pat. No. 6,794,136, incorporated herein by reference in its entirety. In addition, individual zinc finger domains may be linked together using any suitable linker sequences. Examples of linker sequences are publicly known, e. g., see U.S. Pat. Nos. 6,479,626; 6,903,185; and 7,153,949, incorporated herein by reference in their entirety. The nucleic acid cleavage domain is non-specific and is typically a restriction endonuclease, such as Fok1. This endonuclease must dimerize to cleave DNA. Thus, cleavage by Fok1 as part of a ZFN requires two adjacent and independent binding events, which must occur in both the correct orientation and with appropriate spacing to permit dimer formation. The requirement for two DNA binding events enables more specific targeting of long and potentially unique recognition sites. Fok1 variants with enhanced activities have been described; see, e. g., Guo et al. (2010) *J. Mol. Biol.*, 400:96-107.

Transcription activator like effectors (TALEs) are proteins secreted by certain *Xanthomonas* species to modulate gene expression in host plants and to facilitate the colonization by and survival of the bacterium. TALEs act as transcription factors and modulate expression of resistance genes in the plants. Recent studies of TALEs have revealed the code linking the repetitive region of TALEs with their target DNA-binding sites. TALEs comprise a highly conserved and repetitive region consisting of tandem repeats of mostly 33 or 34 amino acid segments. The repeat monomers differ from each other mainly at amino acid positions 12 and 13. A strong correlation between unique pairs of amino acids at positions 12 and 13 and the corresponding nucleotide in the TALE-binding site has been found. The simple relationship between amino acid sequence and DNA recognition of the TALE binding domain allows for the design of DNA binding domains of any desired specificity. TALEs can be linked to a non-specific DNA cleavage domain to prepare genome editing proteins, referred to as TAL-effector nucleases or TALENs. As in the case of ZFNs, a restriction endonuclease, such as Fok1, can be conveniently used. For a description of the use of TALENs in plants, see Mahfouz et al. (2011) *Proc. Natl. Acad. Sci. USA,* 108:2623-2628 and Mahfouz (2011) *GM Crops,* 2:99-103.

Argonauts are proteins that can function as sequence-specific endonucleases by binding a polynucleotide (e. g., a single-stranded DNA or single-stranded RNA) that includes sequence complementary to a target nucleotide sequence) that guides the Argonaut to the target nucleotide sequence and effects site-specific alteration of the target nucleotide sequence; see, e. g., U. S. Patent Application Publication 2015/0089681, incorporated herein by reference in its entirety.

Another method of effecting targeted changes to a genome is the use of triple-forming peptide nucleic acids (PNAs) designed to bind site-specifically to genomic DNA via strand invasion and the formation of PNA/DNA/PNA triplexes (via both Watson-Crick and Hoogsteen binding) with a displaced DNA strand. PNAs consist of a charge neutral peptide-like backbone and nucleobases. The nucleobases hybridize to DNA with high affinity. The triplexes then recruit the cell's endogenous DNA repair systems to initiate site-specific modification of the genome. The desired sequence modification is provided by single-stranded 'donor DNAs' which are co-delivered as templates for repair. See, e. g., Bahal R et al (2016) *Nature Communications,* Oct. 26, 2016.

In related embodiments, zinc finger nucleases, TALENs, and Argonautes are used in conjunction with other functional domains. For example, the nuclease activity of these nucleic acid targeting systems can be altered so that the enzyme binds to but does not cleave the DNA. Examples of functional domains include transposase domains, integrase domains, recombinase domains, resolvase domains, invertase domains, protease domains, DNA methyltransferase domains, DNA hydroxylmethylase domains, DNA demethylase domains, histone acetylase domains, histone deacetylase domains, nuclease domains, repressor domains, activator domains, nuclear-localization signal domains, transcription-regulatory protein (or transcription complex recruiting) domains, cellular uptake activity associated domains, nucleic acid binding domains, antibody presentation domains, histone modifying enzymes, recruiter of histone modifying enzymes; inhibitor of histone modifying enzymes, histone methyltransferases, histone demethylases, histone kinases, histone phosphatases, histone ribosylases, histone deribosylases, histone ubiquitinases, histone deubiquitinases, histone biotinases and histone tail proteases. Non-limiting examples of functional domains include a transcriptional activation domain, a transcription repression domain, and an SHH1, SUVH2, or SUVH9 polypeptide capable of reducing expression of a target nucleotide sequence via epigenetic modification; see, e. g., U. S. Patent Application Publication 2016/0017348, incorporated herein by reference in its entirety. Genomic DNA may also be modified via base editing using a fusion between a catalytically inactive Cas9 (dCas9) is fused to a cytidine deaminase which convert cytosine (C) to uridine (U), thereby effecting a C to T substitution; see Komor et al. (2016) *Nature,* 533:420-424.

In embodiments, the guide RNA (gRNA) has a sequence of between 16-24 nucleotides in length (e. g., 16, 17, 18, 19, 20, 21, 22, 23, or 24 nucleotides in length). Specific embodiments include gRNAs of 19, 20, or 21 nucleotides in length and having 100% complementarity to the target nucleotide sequence. In many embodiments the gRNA has exact complementarity (i.e., perfect base-pairing) to the target nucleotide sequence; in certain other embodiments the gRNA has less than 100% complementarity to the target nucleotide sequence. The design of effective gRNAs for use in plant genome editing is disclosed in U. S. Patent Application Publication 2015/0082478 A1, the entire specification of which is incorporated herein by reference. In embodiments where multiple gRNAs are employed, the multiple gRNAs can be delivered separately (as separate RNA molecules or encoded by separate DNA molecules) or in combination, e. g., as an RNA molecule containing multiple gRNA sequences, or as a DNA molecule encoding an RNA molecule containing multiple gRNA sequences; see, for example, U.S. Patent Application Publication 2016/0264981 A1, the entire specification of which is incorporated herein by reference, which discloses RNA molecules including multiple RNA sequences (such as gRNA sequences) separated by tRNA cleavage sequences. In other embodiments, a DNA molecule encodes multiple gRNAs which are separated by other types of cleavable transcript, for example, small RNA (e. g., miRNA, siRNA, or ta-siRNA) recognition sites which can be cleaved by the corresponding small RNA, or dsRNA-forming regions which can be cleaved by a Dicer-type ribonuclease, or sequences which are recognized by RNA nucleases such as Cys4 ribonuclease from *Pseudomonas aeruginosa*; see, e. g., U.S. Pat. No. 7,816,581, the entire specification of which is incorporated herein by reference, which discloses in FIG. 27 and elsewhere in the specification pol II promoter-driven DNA constructs encoding RNA transcripts that are released by cleavage. Efficient Cas9-mediated gene editing has been achieved using a chimeric "single guide RNA" ("sgRNA"), an engineered (synthetic) single RNA molecule that mimics a naturally occurring crRNA-tracrRNA complex and contains both a tracrRNA (for binding the nuclease) and at least one crRNA (to guide the nuclease to the sequence targeted for editing). In other embodiments, self-cleaving ribozyme sequences can be used to separate multiple gRNA sequences within a transcript.

Thus, in certain embodiments wherein the nuclease is a Cas9-type nuclease, the gRNA can be provided as a polynucleotide composition including: (a) a CRISPR RNA (crRNA) that includes the gRNA together with a separate tracrRNA, or (b) at least one polynucleotide that encodes a crRNA and a tracrRNA (on a single polynucleotide or on separate polynucleotides), or (c) at least one polynucleotide that is processed into one or more crRNAs and a tracrRNA. In other embodiments wherein the nuclease is a Cas9-type nuclease, the gRNA can be provided as a polynucleotide composition including a CRISPR RNA (crRNA) that includes the gRNA, and the required tracrRNA is provided in a separate composition or in a separate step, or is otherwise provided to the cell (for example, to a plant cell or plant protoplast that stably or transiently expresses the tracrRNA from a polynucleotide encoding the tracrRNA). In other embodiments wherein the nuclease is a Cas9-type nuclease, the gRNA can be provided as a polynucleotide composition comprising: (a) a single guide RNA (sgRNA) that includes the gRNA, or (b) a polynucleotide that encodes a sgRNA, or (c) a polynucleotide that is processed into a sgRNA. Cpf1-mediated gene editing does not require a tracrRNA; thus, in embodiments wherein the nuclease is a Cpf1-type nuclease, the gRNA is provided as a polynucleotide composition comprising (a) a CRISPR RNA (crRNA) that includes the gRNA, or (b) a polynucleotide that encodes a crRNA, or (c) a polynucleotide that is processed into a crRNA. In embodiments, the gRNA-containing composition optionally includes an RNA-guided nuclease, or a polynucleotide that encodes the RNA-guided nuclease. In other embodiments, an RNA-guided nuclease or a polynucleotide that encodes the RNA-guided nuclease is provided in a separate step. In some embodiments of the method, a gRNA is provided to a cell (e. g., a plant cell or plant protoplast) that includes an RNA-guided nuclease or a polynucleotide that encodes an RNA-guided nuclease, e. g., an RNA-guided nuclease selected from the group consisting of an RNA-guided DNA endonuclease, a type II Cas nuclease, a Cas9, a type V Cas nuclease, a Cpf1, a CasY, a CasX, a C2c1, a C2c3, an engineered RNA-guided nuclease, and a codon-optimized RNA-guided nuclease; in an example, the cell (e. g., a plant cell or plant protoplast) stably or transiently expresses the RNA-guided nuclease. In embodiments, the polynucleotide that encodes the RNA-guided nuclease is, for example, DNA that encodes the RNA-guided nuclease and is stably integrated in the genome of a plant cell or plant protoplast, DNA or RNA that encodes the RNA-guided nuclease and is transiently present in or introduced into a plant cell or plant protoplast; such DNA or RNA can be introduced, e. g., by using a vector such as a plasmid or viral vector or as an mRNA, or as vector-less DNA or RNA introduced directly into a plant cell or plant protoplast.

In embodiments that further include the step of providing to a cell (e. g., a plant cell or plant protoplast) an RNA-guided nuclease or a polynucleotide that encodes the RNA-guided nuclease, the RNA-guided nuclease is provided simultaneously with the gRNA-containing composition, or in a separate step that precedes or follows the step of providing the gRNA-containing composition. In embodiments, the gRNA-containing composition further includes an RNA-guided nuclease or a polynucleotide that encodes the RNA-guided nuclease. In other embodiments, there is provided a separate composition that includes an RNA-guided nuclease or a polynucleotide that encodes the RNA-guided nuclease. In embodiments, the RNA-guided nuclease is provided as a ribonucleoprotein (RNP) complex, e. g., a preassembled RNP that includes the RNA-guided nuclease complexed with a polynucleotide including the gRNA or encoding a gRNA, or a preassembled RNP that includes a polynucleotide that encodes the RNA-guided nuclease (and optionally encodes the gRNA, or is provided with a separate polynucleotide including the gRNA or encoding a gRNA), complexed with a protein. In embodiments, the RNA-guided nuclease is a fusion protein, i. e., wherein the RNA-guided nuclease (e. g., Cas9, Cpf1, CasY, CasX, C2c1, or C2c3) is covalently bound through a peptide bond to a cell-penetrating peptide, a nuclear localization signal peptide, a chloroplast transit peptide, or a mitochondrial targeting peptide; such fusion proteins are conveniently encoded in a single nucleotide sequence, optionally including codons for linking amino acids. In embodiments, the RNA-guided nuclease or a polynucleotide that encodes the RNA-guided nuclease is provided as a complex with a cell-penetrating peptide or other transfecting agent. In embodiments, the RNA-guided nuclease or a polynucleotide that encodes the RNA-guided nuclease is complexed with, or covalently or non-covalently bound to, a further element, e. g., a carrier molecule, an antibody, an antigen, a viral movement protein, a polymer, a detectable label (e. g., a moiety detectable by fluorescence, radioactivity, or enzymatic or immunochemical reaction), a quantum dot, or a particulate or nanoparticulate. In embodiments, the RNA-guided nuclease or a polynucleotide that encodes the RNA-guided nuclease is provided in a solution, or is provided in a liposome, micelle, emulsion, reverse emulsion, suspension, or other mixed-phase composition.

An RNA-guided nuclease can be provided to a cell (e. g., a plant cell or plant protoplast) by any suitable technique. In embodiments, the RNA-guided nuclease is provided by directly contacting a plant cell or plant protoplast with the RNA-guided nuclease or the polynucleotide that encodes the RNA-guided nuclease. In embodiments, the RNA-guided nuclease is provided by transporting the RNA-guided nuclease or a polynucleotide that encodes the RNA-guided nuclease into a plant cell or plant protoplast using a chemical, enzymatic, or physical agent as provided in detail in the paragraphs following the heading "Delivery Methods and Delivery Agents". In embodiments, the RNA-guided nuclease is provided by bacterially mediated (e. g., *Agrobacterium* sp., *Rhizobium* sp., *Sinorhizobium* sp., *Mesorhizobium* sp., *Bradyrhizobium* sp., *Azobacter* sp., *Phyllobacterium* sp.) transfection of a plant cell or plant protoplast with a polynucleotide encoding the RNA-guided nuclease; see, e. g., Broothaerts et al. (2005) *Nature,* 433:629-633. In an embodiment, the RNA-guided nuclease is provided by transcription in a plant cell or plant protoplast of a DNA that encodes the RNA-guided nuclease and is stably integrated in the genome of the plant cell or plant protoplast or that is provided to the plant cell or plant protoplast in the form of a plasmid or expression vector (e. g., a viral vector) that encodes the RNA-guided nuclease (and optionally encodes one or more gRNAs, crRNAs, or sgRNAs, or is optionally provided with a separate plasmid or vector that encodes one or more gRNAs, crRNAs, or sgRNAs). In embodiments, the RNA-guided nuclease is provided to the plant cell or plant protoplast as a polynucleotide that encodes the RNA-guided nuclease, e. g., in the form of an mRNA encoding the nuclease.

Where a polynucleotide is concerned (e. g., a crRNA that includes the gRNA together with a separate tracrRNA, or a crRNA and a tracrRNA encoded on a single polynucleotide or on separate polynucleotides, or at least one polynucleotide that is processed into one or more crRNAs and a tracrRNA, or a sgRNA that includes the gRNA, or a polynucleotide that encodes a sgRNA, or a polynucleotide that is processed into a sgRNA, or a polynucleotide that encodes the RNA-guided nuclease), embodiments of the polynucleotide include: (a) double-stranded RNA; (b) single-stranded RNA; (c) chemically modified RNA; (d) double-stranded DNA; (e) single-stranded DNA; (f) chemically modified DNA; or (g) a combination of (a)-(f). Where expression of a polynucleotide is involved (e. g., expression of a crRNA from a DNA encoding the crRNA, or expression and translation of a RNA-guided nuclease from a DNA encoding the nuclease), in some embodiments it is sufficient that expression be transient, i. e., not necessarily permanent or stable in the cell. Certain embodiments of the polynucleotide further include additional nucleotide sequences that provide useful functionality; non-limiting examples of such additional nucleotide sequences include an aptamer or riboswitch sequence, nucleotide sequence that provides secondary structure such as stem-loops or that provides a sequence-specific site for an enzyme (e. g., a sequence-specific recombinase or endonuclease site), T-DNA (e. g., DNA sequence encoding a gRNA, crRNA, tracrRNA, or sgRNA is enclosed between left and right T-DNA borders from *Agrobacterium* spp. or from other bacteria that infect or induce tumours in plants), a DNA nuclear-targeting sequence, a regulatory sequence such as a promoter sequence, and a transcript-stabilizing sequence. Certain embodiments of the polynucleotide include those wherein the polynucleotide is complexed with, or covalently or non-covalently bound to, a non-nucleic acid element, e. g., a carrier molecule, an antibody, an antigen, a viral movement protein, a cell-penetrating or pore-forming peptide, a polymer, a detectable label, a quantum dot, or a particulate or nanoparticulate.

In embodiments, the at least one DSB is introduced into the genome by at least one treatment selected from the group consisting of: (a) bacterially mediated (e. g., *Agrobacterium* sp., *Rhizobium* sp., *Sinorhizobium* sp., *Mesorhizobium* sp., *Bradyrhizobium* sp., *Azobacter* sp., *Phyllobacterium* sp.) transfection with a DSB-inducing agent; (b) Biolistics or particle bombardment with a DSB-inducing agent; (c) treatment with at least one chemical, enzymatic, or physical agent as provided in detail in the paragraphs following the heading "Delivery Methods and Delivery Agents"; and (d) application of heat or cold, ultrasonication, centrifugation, positive or negative pressure, cell wall or membrane disruption or deformation, or electroporation. It is generally desirable that introduction of the at least one DSB into the genome (i. e., the "editing" of the genome) is achieved with sufficient efficiency and accuracy to ensure practical utility. One measure of efficiency is the percentage or fraction of the population of cells that have been treated with a DSB-inducing agent and in which the DSB is successfully introduced at the correct site in the genome. The efficiency of genome editing is assessed by any suitable method such as a heteroduplex cleavage assay or by sequencing, as described elsewhere in this disclosure. Accuracy is indicated by the absence of, or minimal occurrence of, off-target introduction of a DSB (i. e., at other than the intended site in the genome).

The location where the at least one DSB is inserted varies according to the desired result, for example whether the intention is to simply disrupt expression of the sequence of interest, or to add functionality (such as placing expression of the sequence of interest under inducible control). Thus, the location of the DSB is not necessarily within or directly adjacent to the sequence of interest. In embodiments, the at least one DSB in a genome is located: (a) within the sequence of interest, (b) upstream of (i. e., 5' to) the sequence of interest, or (c) downstream of (i. e., 3' to) the sequence of interest. In embodiments, a sequence encoded by the polynucleotide (such as a double-stranded DNA, a single-stranded DNA, a single-stranded DNA/RNA hybrid, or a double-stranded DNA/RNA hybrid) donor molecule, when integrated into the genome, is functionally or operably linked (e. g., linked in a manner that modifies the transcription or the translation of the sequence of interest or that modifies the stability of a transcript including that of the sequence of interest) to the sequence of interest. In embodiments, a sequence encoded by the polynucleotide donor molecule is integrated at a location 5' to and operably linked to the sequence of interest, wherein the integration location is selected to provide a specifically modulated (upregulated or downregulated) level of expression of the sequence of interest. For example, a sequence encoded by the polynucleotide donor molecule is integrated at a specific location in the promoter region of a protein-encoding gene that results in a desired expression level of the protein; in an embodiment, the appropriate location is determined empirically by integrating a sequence encoded by the polynucleotide donor molecule at about 50, about 100, about 150, about 200, about 250, about 300, about 350, about 400, about 450, and about 500 nucleotides 5' to (upstream of) the start codon of the coding sequence, and observing the relative expression levels of the protein for each integration location.

In embodiments, the donor polynucleotide sequence of interest includes coding (protein-coding) sequence, non-coding (non-protein-coding) sequence, or a combination of coding and non-coding sequence. Embodiments include a plant nuclear sequence, a plant plastid sequence, a plant mitochondrial sequence, a sequence of a symbiont, pest, or pathogen of a plant, and combinations thereof. Embodiments include exons, introns, regulatory sequences including promoters, other 5' elements and 3' elements, and genomic loci encoding non-coding RNAs including long non-coding RNAs (lncRNAs), microRNAs (miRNAs), and trans-acting siRNAs (ta-siRNAs). In embodiments, multiple sequences are altered, for example, by delivery of multiple gRNAs to the plant cell or plant protoplast; the multiple sequences can be part of the same gene (e. g., different locations in a single coding region or in different exons or introns of a protein-coding gene) or different genes. In embodiments, the sequence of an endogenous genomic locus is altered to delete, add, or modify a functional non-coding sequence; in non-limiting examples, such functional non-coding sequences include, e. g., a miRNA, siRNA, or ta-siRNA recognition or cleavage site, a splice site, a recombinase recognition site, a transcription factor binding site, or a transcriptional or translational enhancer or repressor sequence.

In embodiments, the invention provides a method of changing expression of a sequence of interest in a genome, including integrating a sequence encoded by a polynucleotide (such as a double-stranded DNA, a single-stranded DNA, a single-stranded DNA/RNA hybrid, or a double-stranded DNA/RNA hybrid) donor molecule at the site of two or more DSBs in a genome. In embodiments, the sequence of the polynucleotide donor molecule that is integrated into each of the two or more DSBs is (a) identical, or (b) different, for each of the DSBs. In embodiments, the change in expression of a sequence of interest in genome is manifested as the expression of an altered or edited sequence of interest; in non-limiting examples, the method is used to integrate sequence-specific recombinase recognition site sequences at two DSBs in a genome, whereby, in the presence of the corresponding site-specific DNA recombinase, the genomic sequence flanked on either side by the integrated recombinase recognition sites is excised from the genome (or in some instances is inverted); such an approach is useful, e. g., for deletion of larger lengths of genomic sequence, for example, deletion of all or part of an exon or of one or more protein domains. In other embodiments, at least two DSBs are introduced into a genome by one or more nucleases in such a way that genomic sequence is deleted between the DSBs (leaving a deletion with blunt ends, overhangs or a combination of a blunt end and an overhang), and a sequence encoded by at least one polynucleotide donor molecule is integrated between the DSBs (i. e., a sequence encoded by at least one individual polynucleotide donor molecule is integrated at the location of the deleted genomic sequence), wherein the genomic sequence that is deleted is coding sequence, non-coding sequence, or a combination of coding and non-coding sequence; such embodiments provide the advantage of not requiring a specific PAM site at or very near the location of a region wherein a nucleotide sequence change is desired. In an embodiment, at least two DSBs are introduced into a genome by one or more nucleases in such a way that genomic sequence is deleted between the DSBs (leaving a deletion with blunt ends, overhangs or a combination of a blunt end and an overhang), and at least one sequence encoded by a polynucleotide donor molecule is integrated between the DSBs (i. e., at least one individual sequence encoded by a polynucleotide donor molecule is integrated at the location of the deleted genomic sequence). In an embodiment, two DSBs are introduced into a genome, resulting in excision or deletion of genomic sequence between the sites of the two DSBs, and a sequence encoded by a polynucleotide donor molecule integrated into the genome at the location of the deleted genomic sequence (that is, a sequence encoded by an individual polynucleotide donor molecule is integrated between the two DSBs). Generally, the polynucleotide donor molecule with the sequence to be integrated into the genome is selected in terms of the presence or absence of terminal overhangs to match the type of DSBs introduced. In an embodiment, two blunt-ended DSBs are introduced into a genome, resulting in excision or deletion of genomic sequence between the sites of the two blunt-ended DSBs, and a sequence encoded by a blunt-ended double-stranded DNA or blunt-ended double-stranded DNA/RNA hybrid or a single-stranded DNA or a single-stranded DNA/RNA hybrid donor molecule is integrated into the genome between the two blunt-ended DSBs. In another embodiment, two DSBs are introduced into a genome, wherein the first DSB is blunt-ended and the second DSB has an overhang, resulting in deletion of genomic sequence between the two DSBs, and a sequence encoded by a double-stranded DNA or double-stranded DNA/RNA hybrid donor molecule that is blunt-ended at one terminus and that has an overhang on the other terminus (or, alternatively, a single-stranded DNA or a single-stranded DNA/RNA hybrid molecule) is integrated into the genome between the two DSBs; in an alternative embodiment, two DSBs are introduced into a genome, wherein both DSBs have overhangs but of different overhang lengths (different number of unpaired nucleotides), resulting in deletion of genomic sequence between the two DSBs, and a sequence encoded by a double-stranded DNA or double-stranded DNA/RNA hybrid donor molecule that has overhangs at each terminus, wherein the overhangs are of unequal lengths (or, alternatively, a single-stranded DNA or a single-stranded DNA/RNA hybrid donor molecule), is integrated into the genome between the two DSBs; embodiments with such DSB asymmetry (i. e., a combination of DSBs having a blunt end and an overhang, or a combination of DSBs having overhangs of unequal lengths) provide the opportunity for controlling directionality or orientation of the inserted polynucleotide, e. g., by selecting a double-stranded DNA or double-stranded DNA/RNA hybrid donor molecule having one blunt end and one terminus with unpaired nucleotides, such that the polynucleotide is integrated preferably in one orientations. In another embodiment, two DSBs, each having an overhang, are introduced into a genome, resulting in excision or deletion of genomic sequence between the sites of the two DSBs, and a sequence encoded by a double-stranded DNA or double-stranded DNA/RNA hybrid donor molecule that has an overhang at each terminus (or, alternatively, a single-stranded DNA or a single-stranded DNA/RNA hybrid donor molecule) is integrated into the genome between the two DSBs. The length of genomic sequence that is deleted between two DSBs and the length of a sequence encoded by the polynucleotide donor molecule that is integrated in place of the deleted genomic sequence can be, but need not be equal. In embodiments, the distance between any two DSBs (or the length of the genomic sequence that is to be deleted) is at least 10, at least 15, at least 20, at least 25, at least 30, at least 40, at least 50, at least 60, at least 70, at least 80, or at least 100 nucleotides; in other embodiments the distance between any two DSBs (or the length of the genomic sequence that is to be deleted) is at least 100, at least 150, at least 200, at least 300, at least 400, at least 500, at least 600, at least 750, or at least 1000 nucleotides. In embodiments where more than two DSBs are introduced into genomic sequence, it is possible to effect different deletions of genomic sequence (for example, where three DSBs are introduced, genomic sequence can be deleted between the first and second DSBs, between the first and third DSBs, and between the second and third DSBs). In some embodiments, a sequence encoded by more than one polynucleotide donor molecule (e. g., multiple copies of a sequence encoded by a polynucleotide donor molecule having a given sequence, or multiple sequences encoded by polynucleotide donor molecules with two or more different sequences) is integrated into the genome. For example, different sequences encoded by individual polynucleotide donor molecules can be individually integrated at a single locus where genomic sequence has been deleted between two DSBs, or at multiple locations where genomic sequence has been deleted (e. g., where more than two DSBs have been introduced into the genome). In embodiments, at least one exon is replaced by integrating a sequence encoded by at least one polynucleotide molecule where genomic sequence is deleted between DSBs that were introduced by at least one sequence-specific nuclease into intronic sequence flanking the at least one exon; an advantage of this approach over an otherwise similar method (i. e., differing by having the DSBs introduced into coding sequence instead of intronic sequence) is the avoidance of inaccuracies (nucleotide changes, deletions, or additions at the nuclease cleavage sites) in the resulting exon sequence or messenger RNA.

In embodiments, the methods described herein are used to delete or replace genomic sequence, which can be a relatively large sequence (e. g., all or part of at least one exon or of a protein domain) resulting in the equivalent of an alternatively spliced transcript. Additional related aspects include compositions and reaction mixtures including a plant cell or a plant protoplast and at least two guide RNAs, wherein each guide RNA is designed to effect a DSB in intronic sequence flanking at least one exon; such compositions and reaction mixtures optionally include at least one sequence-specific nuclease capable of being guided by at least one of the guide RNAs to effect a DSB in genomic sequence, and optionally include a polynucleotide donor molecule that is capable of being integrated (or having its sequence integrated) into the genome at the location of at least one DSB or at the location of genomic sequence that is deleted between the DSBs.

Donor Polynucleotide Molecules: Embodiments of the polynucleotide donor molecule having a sequence that is integrated at the site of at least one double-strand break (DSB) in a genome include double-stranded DNA, a single-stranded DNA, a single-stranded DNA/RNA hybrid, and a double-stranded DNA/RNA hybrid. In embodiments, a polynucleotide donor molecule that is a double-stranded (e. g., a dsDNA or dsDNA/RNA hybrid) molecule is provided directly to the plant protoplast or plant cell in the form of a double-stranded DNA or a double-stranded DNA/RNA hybrid, or as two single-stranded DNA (ssDNA) molecules that are capable of hybridizing to form dsDNA, or as a single-stranded DNA molecule and a single-stranded RNA (ssRNA) molecule that are capable of hybridizing to form a double-stranded DNA/RNA hybrid; that is to say, the double-stranded polynucleotide molecule is not provided indirectly, for example, by expression in the cell of a dsDNA encoded by a plasmid or other vector. In various non-limiting embodiments of the method, the polynucleotide donor molecule that is integrated (or that has a sequence that is integrated) at the site of at least one double-strand break (DSB) in a genome is double-stranded and blunt-ended; in other embodiments the polynucleotide donor molecule is double-stranded and has an overhang or "sticky end" consisting of unpaired nucleotides (e. g., 1, 2, 3, 4, 5, or 6 unpaired nucleotides) at one terminus or both termini. In an embodiment, the DSB in the genome has no unpaired nucleotides at the cleavage site, and the polynucleotide donor molecule that is integrated (or that has a sequence that is integrated) at the site of the DSB is a blunt-ended double-stranded DNA or blunt-ended double-stranded DNA/RNA hybrid molecule, or alternatively is a single-stranded DNA or a single-stranded DNA/RNA hybrid molecule. In another embodiment, the DSB in the genome has one or more unpaired nucleotides at one or both sides of the cleavage site, and the polynucleotide donor molecule that is integrated (or that has a sequence that is integrated) at the site of the DSB is a double-stranded DNA or double-stranded DNA/RNA hybrid molecule with an overhang or "sticky end" consisting of unpaired nucleotides at one or both termini, or alternatively is a single-stranded DNA or a single-stranded DNA/RNA hybrid molecule; in embodiments, the polynucleotide donor molecule DSB is a double-stranded DNA or double-stranded DNA/RNA hybrid molecule that includes an overhang at one or at both termini, wherein the overhang consists of the same number of unpaired nucleotides as the number of unpaired nucleotides created at the site of a DSB by a nuclease that cuts in an off-set fashion (e. g., where a Cpf1 nuclease effects an off-set DSB with 5-nucleotide overhangs in the genomic sequence, the polynucleotide donor molecule that is to be integrated (or that has a sequence that is to be integrated) at the site of the DSB is double-stranded and has 5 unpaired nucleotides at one or both termini). Generally, one or both termini of the polynucleotide donor molecule contain no regions of sequence homology (identity or complementarity) to genomic regions flanking the DSB; that is to say, one or both termini of the polynucleotide donor molecule contain no regions of sequence that is sufficiently complementary to permit hybridization to genomic regions immediately adjacent to the location of the DSB. In embodiments, the polynucleotide donor molecule contains no homology to the locus of the DSB, that is to say, the polynucleotide donor molecule contains no nucleotide sequence that is sufficiently complementary to permit hybridization to genomic regions immediately adjacent to the location of the DSB. In an embodiment, the polynucleotide donor molecule that is integrated at the site of at least one double-strand break (DSB) includes between 2-20 nucleotides in one (if single-stranded) or in both strands (if double-stranded), e. g., 2, 3, 4, 5, 6, 7, 8, 9, 10, 11, 12, 13, 14, 15, 16, 17, 18, 19, or 20 nucleotides on one or on both strands, each of which can be base-paired to a nucleotide on the opposite strand (in the case of a perfectly base-paired double-stranded polynucleotide molecule). In embodiments, the polynucleotide donor molecule is at least partially double-stranded and includes 2-20 base-pairs, e. g., 2, 3, 4, 5, 6, 7, 8, 9, 10, 11, 12, 13, 14, 15, 16, 17, 18, 19, or 20 base-pairs; in embodiments, the polynucleotide donor molecule is double-stranded and blunt-ended and consists of 2-20 base-pairs, e. g., 2, 3, 4, 5, 6, 7, 8, 9, 10, 11, 12, 13, 14, 15, 16, 17, 18, 19, or 20 base-pairs; in other embodiments, the polynucleotide donor molecule is double-stranded and includes 2-20 base-pairs, e. g., 2, 3, 4, 5, 6, 7, 8, 9, 10, 11, 12, 13, 14, 15, 16, 17, 18, 19, or 20 base-pairs and in addition has at least one overhang or "sticky end" consisting of at least one additional, unpaired nucleotide at one or at both termini. Non-limiting examples of such relatively small polynucleotide donor molecules of 20 or fewer base-pairs (if double-stranded) or 20 or fewer nucleotides (if single-stranded) include polynucleotide donor molecules that have at least one strand including a transcription factor recognition site sequence (e. g., such as the sequences of transcription factor recognition sites provided in the working Examples), or that have at least one strand including a small RNA recognition site, or that have at least one strand including a recombinase recognition site. In an embodiment, the polynucleotide donor molecule that is integrated (or that has a sequence that is integrated) at the site of at least one double-strand break (DSB) in a genome is a blunt-ended double-stranded DNA or a blunt-ended double-stranded DNA/RNA hybrid molecule of about 18 to about 300 base-pairs, or about 20 to about 200 base-pairs, or about 30 to about 100 base-pairs, and having at least one phosphorothioate bond between adjacent nucleotides at a 5' end, 3' end, or both 5' and 3' ends. In embodiments, the polynucleotide donor molecule includes single strands of at least 11, at least 18, at least 20, at least 30, at least 40, at least 60, at least 80, at least 100, at least 120, at least 140, at least 160, at least 180, at least 200, at least 240, at about 280, or at least 320 nucleotides. In embodiments, the polynucleotide donor molecule has a length of at least 2, at least 3, at least 4, at least 5, at least 6, at least 7, at least 8, at least 9, at least 10, or at least 11 base-pairs if double-stranded (or nucleotides if single-stranded), or between about 2 to about 320 base-pairs if double-stranded (or nucleotides if single-stranded), or between about 2 to about 500 base-pairs if double-stranded (or nucleotides if single-stranded), or between about 5 to about 500 base-pairs if double-stranded (or nucleotides if single-stranded), or between about 5 to about 300 base-pairs if double-stranded (or nucleotides if single-stranded), or between about 11 to about 300 base-pairs if double-stranded (or nucleotides if single-stranded), or about 18 to about 300 base-pairs if double-stranded (or nucleotides if single-stranded), or between about 30 to about 100 base-pairs if double-stranded (or nucleotides if single-stranded). In embodiments, the polynucleotide donor molecule includes chemically modified nucleotides (see, e. g., the various modifications of internucleotide linkages, bases, and sugars described in Verma and Eckstein (1998) *Annu. Rev. Biochem.*, 67:99-134); in embodiments, the naturally occurring phosphodiester backbone of the polynucleotide donor molecule is partially or completely modified with phosphorothioate, phosphorodithioate, or methylphosphonate internucleotide linkage modifications, or the polynucleotide donor molecule includes modified nucleoside bases or modified sugars, or the polynucleotide donor molecule is labelled with a fluorescent moiety (e. g., fluorescein or rhodamine or a fluorescent nucleoside analogue) or other detectable label (e. g., biotin or an isotope). In an embodiment, the polynucleotide donor molecule is double-stranded and perfectly base-paired through all or most of its length, with the possible exception of any unpaired nucleotides at either terminus or both termini. In another embodiment, the polynucleotide donor molecule is double-stranded and includes one or more non-terminal mismatches or non-terminal unpaired nucleotides within the otherwise double-stranded duplex. In another embodiment, the polynucleotide donor molecule contains secondary structure that provides stability or acts as an aptamer. Other related embodiments include double-stranded DNA/RNA hybrid molecules, single-stranded DNA/RNA hybrid donor molecules, and single-stranded DNA donor molecules (including single-stranded, chemically modified DNA donor molecules), which in analogous procedures are integrated (or have a sequence that is integrated) at the site of a double-strand break.

In embodiments of the method, the polynucleotide (such as a double-stranded DNA, a single-stranded DNA, a single-stranded DNA/RNA hybrid, or a double-stranded DNA/RNA hybrid) donor molecule that is integrated at the site of at least one double-strand break (DSB) in a genome includes nucleotide sequence(s) on one or on both strands that provide a desired functionality when the polynucleotide is integrated into the genome. In various non-limiting embodiments of the method, the sequence encoded by a donor polynucleotide that is inserted at the site of at least one double-strand break (DSB) in a genome includes at least one sequence selected from the group consisting of:

(a) DNA encoding at least one stop codon, or at least one stop codon on each strand, or at least one stop codon within each reading frame on each strand;
(b) DNA encoding heterologous primer sequence (e. g., a sequence of about 18 to about 22 contiguous nucleotides, or of at least 18 contiguous nucleotides, that can be used to initiate DNA polymerase activity at the site of the DSB);
(c) DNA encoding a unique identifier sequence (e. g., a sequence that when inserted at the DSB creates a heterologous sequence that can be used to identify the presence of the insertion); (d) DNA encoding a transcript-stabilizing sequence;
(e) DNA encoding a transcript-destabilizing sequence;
(f) a DNA aptamer or DNA encoding an RNA aptamer or amino acid aptamer; and
(g) DNA that includes or encodes a sequence recognizable by a specific binding agent.

In an embodiment, the sequence encoded by the polynucleotide (such as a double-stranded DNA, a single-stranded DNA, a single-stranded DNA/RNA hybrid, or a double-stranded DNA/RNA hybrid) donor molecule that is integrated at the site of at least one double-strand break (DSB) in a genome includes DNA encoding at least one stop codon, or at least one stop codon on each strand, or at least one stop codon within each reading frame on each strand. Such sequence encoded by a polynucleotide donor molecule, when integrated at a DSB in a genome can be useful for disrupting the expression of a sequence of interest, such as a protein-coding gene. An example of such a polynucleotide donor molecule is a double-stranded DNA, a single-stranded DNA, a single-stranded DNA/RNA hybrid, or a double-stranded DNA/RNA hybrid donor molecule, of at least 18 contiguous base-pairs if double-stranded or at least 11 contiguous nucleotides if single-stranded, and encoding at least one stop codon in each possible reading frame on either strand. Another example of such a polynucleotide donor molecule is a double-stranded DNA or double-stranded DNA/RNA hybrid donor molecule wherein each strand includes at least 18 and fewer than 200 contiguous base-pairs, wherein the number of base-pairs is not divisible by 3, and wherein each strand encodes at least one stop codon in each possible reading frame in the 5' to 3' direction. Another example of such a polynucleotide donor molecule is a single-stranded DNA or single-stranded DNA/RNA hybrid donor molecule wherein each strand includes at least 11 and fewer than about 300 contiguous nucleotides, wherein the number of base-pairs is not divisible by 3, and wherein the polynucleotide donor molecule encodes at least one stop codon in each possible reading frame in the 5' to 3' direction.

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes DNA encoding heterologous primer sequence (e. g., a sequence of about 18 to about 22 contiguous nucleotides, or of at least 18, at least 20, or at least 22 contiguous nucleotides that can be used to initiate DNA polymerase activity at the site of the DSB). Heterologous primer sequence can further include nucleotides of the genomic sequence directly flanking the site of the DSB.

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes nucleotides encoding a unique identifier sequence (e. g., a sequence that when inserted at the DSB creates a heterologous sequence that can be used to identify the presence of the insertion)

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes nucleotides encoding a transcript-stabilizing sequence. In an example, sequence of a double-stranded or single-stranded DNA or a DNA/RNA hybrid donor molecule encoding a 5' terminal RNA-stabilizing stem-loop (see, e. g., Suay (2005) Nucleic Acids Rev., 33:4754-4761) is integrated at a DSB located 5' to the sequence for which improved transcript stability is desired. In another embodiment, the polynucleotide donor molecule that is integrated (or that has a sequence that is integrated) at the site of at least one double-strand break (DSB) in a genome includes nucleotides encoding a transcript-destabilizing sequence such as the SAUR destabilizing sequences described in detail in U. S. Patent Application Publication 2007/0011761, incorporated herein by reference.

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes a DNA aptamer or DNA encoding an RNA aptamer or amino acid aptamer. Nucleic acid (DNA or RNA) aptamers are single- or double-stranded nucleotides that bind specifically to molecules or ligands which include small molecules (e. g., secondary metabolites such as alkaloids, terpenes, flavonoids, and other small molecules, as well as larger molecules such as polyketides and non-ribosomal proteins), proteins, other nucleic acid molecules, and inorganic compounds. Introducing an aptamer at a specific location in the genome is useful, e. g., for adding binding specificity to an enzyme or for placing expression of a transcript or activity of an encoded protein under ligand-specific control. In an example, the polynucleotide donor molecule encodes a poly-histidine "tag" which is integrated at a DSB downstream of a protein or protein subunit, enabling the protein expressed from the resulting transcript to be purified by affinity to nickel, e. g., on nickel resins; in an embodiments, the polynucleotide donor molecule encodes a 6×-His tag, a 10×-His tag, or a 10×-His tag including one or more stop codons following the histidine-encoding codons, where the last is particularly useful when integrated downstream of a protein or protein subunit lacking a stop codon (see, e. g., parts[dot]igem[dot]org/Part: BBa_K844000). In embodiments, the polynucleotide donor molecule encodes a riboswitch, wherein the riboswitch includes both an aptamer which changes its conformation in the presence or absence of a specific ligand, and an expression-controlling region that turns expression on or off, depending on the conformation of the aptamer. See, for example, the regulatory RNA molecules containing ligand-specific aptamers described in U. S. Patent Application Publication 2013/0102651 and the various riboswitches described in U. S. Patent Application Publication 2005/0053951, both of which publications are incorporated herein by reference.

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes nucleotides that include or encode a sequence recognizable by (i. e., binds to) a specific binding agent. Non-limiting embodiments of specific binding agents include nucleic acids, peptides or proteins, non-peptide/non-nucleic acid ligands, inorganic molecules, and combinations thereof, specific binding agents also include macromolecular assemblages such as lipid bilayers, cell components or organelles, and even intact cells or organisms. In embodiments, the specific binding agent is an aptamer or riboswitch, or alternatively is recognized by an aptamer or a riboswitch. In an embodiment, the invention provides a method of changing expression of a sequence of interest in a genome, comprising integrating a polynucleotide molecule at the site of a DSB in a genome, wherein the polynucleotide donor molecule includes a sequence recognizable by a specific binding agent, wherein the integrated sequence encoded by the polynucleotide donor molecule is functionally or operably linked to a sequence of interest, and wherein contacting the integrated sequence encoded by the polynucleotide donor molecule with the specific binding agent results in a change of expression of the sequence of interest; in embodiments, sequences encoded by different polynucleotide donor molecules are integrated at multiple DSBs in a genome.

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes nucleotides that include or encode a sequence recognizable by (i. e., binds to) a specific binding agent, wherein:
(a) the sequence recognizable by a specific binding agent includes an auxin response element (AuxRE) sequence, the specific binding agent is an auxin, and the change of expression is upregulation; see, e. g., Walker and Estelle (1998) Curr. Opinion Plant Biol., 1:434-439;

(b) the sequence recognizable by a specific binding agent includes at least one D1-4 sequence ( (CCTCGTGTCTC, SEQ ID NO: 328;

see Ulmasov et al. (1997) Plant Cell, 9:1963-1971), the specific binding agent is an auxin, and the change of expression is upregulation;
(c) the sequence recognizable by a specific binding agent includes at least one DR5 sequence ( (CCTTTTGTCTC, SEQ ID NO: 329;

see Ulmasov et al. (1997) Plant Cell, 9:1963-1971), the specific binding agent is an auxin, and the change of expression is upregulation;
(d) the sequence recognizable by a specific binding agent includes at least one m5-DR5 sequence ( (CCTTTTGTCNC, SEQ ID NO: 330;
wherein N is A, C, or G, see Ulmasov et al. (1997) Plant Cell, 9:1963-1971), the specific binding agent is an auxin, and the change of expression is upregulation;
(e) the sequence recognizable by a specific binding agent includes at least one P3 sequence (TGTCTC, SEQ ID NO: 331), the specific binding agent is an auxin, and the change of expression is upregulation;
(f) the sequence recognizable by a specific binding agent includes a small RNA recognition site sequence, the specific binding agent is the corresponding small RNA (e. g., an siRNA, a microRNA (miRNA), a trans-acting siRNA as described in U.S. Pat. No. 8,030,473, or a phased sRNA as described in U.S. Pat. No. 8,404,928; both of these cited patents are incorporated by reference herein), and the change of expression is downregulation (non-limiting examples are given below, under the heading "Small RNAs");
(g) the sequence recognizable by a specific binding agent includes a microRNA (miRNA) recognition site sequence, the specific binding agent is the corresponding mature miRNA, and the change of expression is downregulation (non-limiting examples are given below, under the heading "Small RNAs");
(h) the sequence recognizable by a specific binding agent includes a microRNA (miRNA) recognition sequence for an engineered miRNA, the specific binding agent is the corresponding engineered mature miRNA, and the change of expression is downregulation;
(i) the sequence recognizable by a specific binding agent includes a transposon recognition sequence, the specific binding agent is the corresponding transposon, and the change of expression is upregulation or downregulation;

(j) the sequence recognizable by a specific binding agent includes an ethylene-responsive element binding-factor-associated am hiphilic repression (EAR) motif (LxLxL, SEQ ID NO: 332
or DLNxxP, SEQ ID NO: 333)

sequence (see, e. g., Ragale and Rozwadowski (2011) *Epigenetics,* 6:141-146), the specific binding agent is ERF (ethylene-responsive element binding factor) or co-repressor (e. g., TOPLESS (TPL)), and the change of expression is downregulation;

(k) the sequence recognizable by a specific binding agent includes a splice site sequence (e. g., a donor site, a branching site, or an acceptor site; see, for example, the splice sites and splicing signals publicly available at the ERIS database, lemur[dot]amu[dot]edu[dot]pl/share/ERISdb/home.html), the specific binding agent is a spliceosome, and the change of expression is expression of an alternatively spliced transcript (in some cases, this can include deletion of a relatively large genomic sequence, such as deletion of all or part of an exon or of a protein domain);

(l) the sequence recognizable by a specific binding agent includes a recombinase recognition site sequence that is recognized by a site-specific recombinase, the specific binding agent is the corresponding site-specific recombinase, and the change of expression is upregulation or downregulation or expression of a transcript having an altered sequence (for example, expression of a transcript that has had a region of DNA excised by the recombinase) (non-limiting examples are given below, under the heading "Recombinases and Recombinase Recognition Sites");

(m) the sequence recognizable by a specific binding agent includes sequence encoding an RNA or amino acid aptamer or an RNA riboswitch, the specific binding agent is the corresponding ligand, and the change in expression is upregulation or downregulation;

(n) the sequence recognizable by a specific binding agent is a hormone responsive element (e. g., a nuclear receptor, or a hormone-binding domain thereof), the specific binding agent is a hormone, and the change in expression is upregulation or downregulation; or (o) the sequence recognizable by a specific binding agent is a transcription factor binding sequence, the specific binding agent is the corresponding transcription factor, and the change in expression is upregulation or downregulation (non-limiting examples are given below, under the heading "Transcription Factors").

In embodiments, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes a nucleotide sequence that encodes an RNA molecule or an amino acid sequence that is recognizable by a specific binding agent. In embodiments, the polynucleotide donor molecule includes a nucleotide sequence that binds specifically to a ligand or that encodes an RNA molecule or an amino acid sequence that binds specifically to a ligand. In embodiments, the polynucleotide donor molecule encodes at least one stop codon on each strand, or encodes at least one stop codon within each reading frame on each strand.

In embodiments, the polynucleotide (such as a double-stranded DNA, a single-stranded DNA, a single-stranded DNA/RNA hybrid, or a double-stranded DNA/RNA hybrid) donor molecule includes at least partially self-complementary sequence, such that the polynucleotide donor molecule encodes a transcript that is capable of forming at least partially double-stranded RNA. In embodiments, the at least partially double-stranded RNA is capable of forming secondary structure containing at least one stem-loop (i. e., a substantially or perfectly double-stranded RNA "stem" region and a single-stranded RNA "loop" connecting opposite strands of the dsRNA stem. In embodiments, the at least partially double-stranded RNA is cleavable by a Dicer or other ribonuclease. In embodiments, the at least partially double-stranded RNA includes an aptamer or a riboswitch; see, e. g., the RNA aptamers described in U. S. Patent Application Publication 2013/0102651, which is incorporated herein by reference.

In embodiments, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes or encodes a nucleotide sequence that is responsive to a specific change in the physical environment (e. g., a change in light intensity or quality, a change in temperature, a change in pressure, a change in osmotic concentration, a change in day length, or addition or removal of a ligand or specific binding agent), wherein exposing the integrated polynucleotide sequence to the specific change in the physical environment results in a change of expression of the sequence of interest. In embodiments, the polynucleotide donor molecule includes a nucleotide sequence encoding an RNA molecule or an amino acid sequence that is responsive to a specific change in the physical environment. In a non-limiting example, the polynucleotide donor molecule encodes an amino acid sequence that is responsive to light, oxygen, redox status, or voltage, such as a Light-Oxygen-Voltage (LOV) domain (see, e. g., Peter et al. (2010) *Nature Communications,* doi: 10.1038/ncomms11121) or a PAS domain (see, e. g., Taylor and Zhulin (1999)*Microbiol. Mol. Biol. Reviews,* 63:479-506), proteins containing such domains, or sub-domains or motifs thereof (see, e. g., the photochemically active 36-residue N-terminal truncation of the VVD protein described by Zoltowski et al. (2007) *Science,* 316:1054-1057). In a non-limiting embodiment, integration of a LOV domain at the site of a DSB within or adjacent to a protein-coding region is used to create a heterologous fusion protein that can be photo-activated.

Small RNAs: In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes DNA that includes or encodes a small RNA recognition site sequence that is recognized by a corresponding mature small RNA. Small RNAs include siRNAs, microRNAs (miRNAs), trans-acting siRNAs (ta-siRNAs) as described in U.S. Pat. No. 8,030,473, and phased small RNAs (phased sRNAs) as described in U.S. Pat. No. 8,404,928. All mature small RNAs are single-stranded RNA molecules, generally between about 18 to about 26 nucleotides in length, which are produced from longer, completely or substantially double-stranded RNA (dsRNA) precursors. For example, siRNAs are generally processed from perfectly or near-perfectly double-stranded RNA precursors, whereas both miRNAs and phased sRNAs are processed from larger precursors that contain at least some mismatched (non-base-paired) nucleotides and often substantial secondary structure such as loops and bulges in the otherwise largely double-stranded RNA precursor. Precursor molecules include naturally occurring precursors, which are often expressed in a specific (e. g., cell- or tissue-specific, temporally specific, developmentally specific, or inducible) expression pattern. Precursor molecules also include engineered precursor molecules, designed to produce small RNAs (e. g., artificial or engineered siRNAs or miRNAs) that target specific sequences; see, e. g., U.S. Pat. Nos. 7,691,995 and 7,786,350, which are incorporated herein by reference in their entirety. Thus, in embodiments, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes DNA that includes or encodes a small RNA precursor sequence designed to be processed in vivo to at least one corresponding mature small RNA. In embodiments, the polynucleotide donor molecule that is integrated (or that has a sequence that is integrated) at the site of at least one double-strand break (DSB) in a genome includes DNA that includes or encodes an engineered small RNA precursor sequence that is based on a naturally occurring "scaffold" precursor sequence but wherein the nucleotides of the encoded mature small RNA are designed to target a specific gene of interest that is different from the gene targeted by the natively encoded small RNA; in embodiments, the "scaffold" precursor sequence is one identified from the genome of a plant or a pest or pathogen of a plant; see, e. g., U.S. Pat. No. 8,410,334, which discloses transgenic expression of engineered invertebrate miRNA precursors in a plant, and which is incorporated herein by reference in its entirety.

Regardless of the pathway that generates the mature small RNA, the mechanism of action is generally similar; the mature small RNA binds in a sequence-specific manner to a small RNA recognition site located on an RNA molecule (such as a transcript or messenger RNA), and the resulting duplex is cleaved by a ribonuclease. The integration of a recognition site for a small RNA at the site of a DSB results in cleavage of the transcript including the integrated recognition site when and where the mature small RNA is expressed and available to bind to the recognition site. For example, a recognition site sequence for a mature siRNA or miRNA that is endogenously expressed only in male reproductive tissue of a plant can be integrated into a DSB, whereby a transcript containing the recognition site sequence is cleaved only where the mature siRNA or miRNA is expressed (i. e., in male reproductive tissue); this is useful, e. g., to prevent expression of a protein in male reproductive tissue such as pollen, and can be used in applications such as to induce male sterility in a plant or to prevent pollen development or shedding. Similarly, a recognition site sequence for a mature siRNA or miRNA that is endogenously expressed only in the roots of a plant can be integrated into a DSB, whereby a transcript containing the recognition site sequence is cleaved only in roots; this is useful, e. g., to prevent expression of a protein in roots. Non-limiting examples of useful small RNAs include: miRNAs having tissue-specific expression patterns disclosed in U.S. Pat. No. 8,334,430, miRNAs having temporally specific expression patterns disclosed in U.S. Pat. No. 8,314,290, miRNAs with stress-responsive expression patterns disclosed in U.S. Pat. No. 8,237,017, siRNAs having tissue-specific expression patterns disclosed in U.S. Pat. No. 9,139,838, and various miRNA recognition site sequences and the corresponding miRNAs disclosed in U. S. Patent Application Publication 2009/0293148. All of the patent publications referenced in this paragraph are incorporated herein by reference in their entirety. In embodiments, multiple edits in a genome are employed to obtain a desired phenotype or trait in plant. In an embodiment, one or more edits (addition, deletion, or substitution of one or more nucleotides) of an endogenous nucleotide sequence is made to provide a general phenotype; addition of at least one small RNA recognition site by insertion of the recognition site sequence at a DSB that is functionally linked to the edited endogenous nucleotide sequence achieves more specific control of expression of the edited endogenous nucleotide sequence. In an example, an endogenous plant 5-enolpyruvylshikimate-3-phosphate synthase (EPSPS) is edited to provide a glyphosate-resistant EPSPS; for example, suitable changes include the amino acid substitutions Threonine-102-Isoleucine (T102I) and Proline-106-Serine (P106S) in the maize EPSPS sequence identified by Genbank accession number X63374 (see, for example U.S. Pat. No. 6,762,344, incorporated herein by reference). In another example, an endogenous plant acetolactate synthase (ALS) is edited to increase resistance of the enzyme to various herbicides (e. g., sulfonylurea, imidazolinone, tirazolopyrimidine, pyrimidinylthiobenzoate, sulfonylamino-carbonyltriazolinone); for example, suitable changes include the amino acid substitutions G115, A116, P191, A199, K250, M345, D370, V565, W568, and F572 to the Nicotiana tabacum ALS enzyme as described in U.S. Pat. No. 5,605,011, which is incorporated herein by reference. The edited herbicide-tolerant enzyme, combined with integration of at least one small RNA recognition site for a small RNA (e. g., an siRNA or a miRNA) expressed only in a specific tissue (for example, miRNAs specifically expressed in male reproductive tissue or female reproductive tissue, e. g., the miRNAs disclosed in Table 6 of U.S. Pat. No. 8,334,430 or the siRNAs disclosed in U.S. Pat. No. 9,139,838, both incorporated herein by reference) at a DSB functionally linked to (e. g., in the 3' untranslated region of) the edited herbicide-tolerant enzyme results in expression of the edited herbicide-tolerant enzyme being restricted to tissues other than those in which the small RNA is endogenously expressed, and those tissues in which the small RNA is expressed will not be resistant to herbicide application; this approach is useful, e. g., to provide male-sterile or female-sterile plants.

In other embodiments, the sequence of an endogenous genomic locus encoding one or more small RNAs (e. g., miRNAs, siRNAs, ta-siRNAs) is altered in order to express a small RNA having a sequence that is different from that of the endogenous small RNA and is designed to target a new sequence of interest (e. g., a sequence of a plant pest, plant pathogen, symbiont of a plant, or symbiont of a plant pest or pathogen). For example, the sequence of an endogenous or native genomic locus encoding a miRNA precursor can be altered in the mature miRNA and the miR* sequences, while maintaining the secondary structure in the resulting altered miRNA precursor sequence to permit normal processing of the transcript to a mature miRNA with a different sequence from the original, native mature miRNA sequence; see, for example, U.S. Pat. Nos. 7,786,350 and 8,395,023, both of which are incorporated by reference in their entirety herein, and which teach methods of designing engineered miRNAs. In embodiments, the sequence of an endogenous genomic locus encoding one or more small RNAs (e. g., miRNAs, siRNAs, ta-siRNAs) is altered in order to express one or more small RNA cleavage blockers (see, e. g., U.S. Pat. No. 9,040,774, which is incorporated by reference in its entirety herein). In embodiments, the sequence of an endogenous genomic locus is altered to encode a small RNA decoy (e. g., U.S. Pat. No. 8,946,511, which is incorporated by reference in its entirety herein). In embodiments, the sequence of an endogenous genomic locus that natively contains a small RNA (e. g., miRNA, siRNA, or ta-siRNA) recognition or cleavage site is altered to delete or otherwise mutate the recognition or cleavage site and thus decouple the genomic locus from small RNA regulation.

Recombinases and Recombinase Recognition Sites: In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes DNA that includes or encodes a recombinase recognition site sequence that is recognized by a site-specific recombinase, the specific binding agent is the corresponding site-specific recombinase, and the change of expression is upregulation or downregulation or expression of a transcript having an altered sequence (for example, expression of a transcript that has had a region of DNA excised by the recombinase). The term "recombinase recognition site sequence" refers to the DNA sequences (usually a pair of sequences) that are recognized by a site-specific (i. e., sequence-specific) recombinase in a process that allows the excision (or, in some cases, inversion or translocation) of the DNA located between the sequence-specific recombination sites. For instance, Cre recombinase recognizes either loxP recombination sites or lox511 recombination sites which are heterospecific, which means that loxP and lox511 do not recombine together (see, e. g., Odell et al. (1994) *Plant Physiol.*, 106:447-458); FLP recombinase recognizes frt recombination sites (see, e. g., Lyznik et al. (1996) *Nucleic Acids Res.*, 24:3784-3789); R recombinase recognizes Rs recombination sites (see, e. g., Onounchi et al. (1991) *Nucleic Acids Res.*, 19:6373-6378); Dre recombinase recognizes rox sites (see, e. g., U.S. Pat. No. 7,422,889, incorporated herein by reference); and Gin recombinase recognizes gix sites (see, e. g., Maeser et al. (1991)*Mol. Gen. Genet.*, 230:170-176). In a non-limiting example, a pair of polynucleotides encoding loxP recombinase recognition site sequences encoded by a pair of polynucleotide donor molecules are integrated at two separate DSBs; in the presence of the corresponding site-specific DNA recombinase Cre, the genomic sequence flanked on either side by the integrated loxP recognition sites is excised from the genome (for loxP sequences that are integrated in the same orientation relative to each other within the genome) or is inverted (for loxP sites that are integrated in an inverted orientation relative to each other within the genome) or is translocated (for loxP sites that are integrated on separate DNA molecules); such an approach is useful, e. g., for deletion or replacement of larger lengths of genomic sequence, for example, deletion or replacement of one or more protein domains. In embodiments, the recombinase recognition site sequences that are integrated at two separate DSBs are heterospecific, i. e., will not recombine together; for example, Cre recombinase recognizes either loxP recombination sites or lox511 recombination sites which are heterospecific relative to each other, which means that a loxP site and a lox511 site will not recombine together but only with another recombination site of its own type.

Integration of recombinase recognition sites is useful in plant breeding; in an embodiment, the method is used to provide a first parent plant having recombinase recognition site sequences heterologously integrated at two separate DSBs; crossing this first parent plant to a second parent plant that expresses the corresponding recombinase results in progeny plants in which the genomic sequence flanked on either side by the heterologously integrated recognition sites is excised from (or in some cases, inverted in) the genome. This approach is useful, e. g., for deletion of relatively large regions of DNA from a genome, for example, for excising DNA encoding a selectable or screenable marker that was introduced using transgenic techniques. Examples of heterologous arrangements or integration patterns of recombinase recognition sites and methods for their use, particularly in plant breeding, are disclosed in U.S. Pat. No. 8,816,153 (see, for example, the Figures and working examples), the entire specification of which is incorporated herein by reference.

Transcription Factors: In an embodiment, the sequence encoded by the donor polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes a transcription factor binding sequence, the specific binding agent is the corresponding transcription factor (or more specifically, the DNA-binding domain of the corresponding transcription factor), and the change in expression is upregulation or downregulation (depending on the type of transcription factor involved). In an embodiment, the transcription factor is an activating transcription factor or activator, and the change in expression is upregulation or increased expression increased expression (e.g., increased expression of at least 10%, 15%, 20%, 25%, 30%, 35%, 40%, 50%, 60%, 70%, 80%, 90%, 95%, 100% or greater, e.g., at least a 2-fold, 5-fold, 10-fold, 20-fold, 30-fold, 40-fold, 50-fold change, 100-fold or even 1000-fold change or greater) of a sequence of interest to which the transcription factor binding sequence, when integrated at a DSB in the genome, is operably linked. In some embodiments, expression is increased between 10-100%; between 2-fold and 5-fold; between 2 and 10-fold; between 10-fold and 50-fold; between 10-fold and a 100-fold; between 100-fold and 1000-fold; between 1000-fold and 5,000-fold; between 5,000-fold and 10,000 fold. In some embodiments, a targeted insertion may decrease expression by at least 1%, 5%, 10%, 15%, 20%, 25%, 30%, 35%, 40%, 50%, 60%, 70%, 80%, 90%, 95%, 99% or more. In another embodiment, the transcription factor is a repressing transcription factor or repressor, and the change in expression is downregulation or decreased expression (e.g., decreased expression by at least 1%, 5%, 10%, 15%, 20%, 25%, 30%, 35%, 40%5, 0%, 60%, 70%, 80%, 90%, 95% 99% or more) of a sequence of interest to which the transcription factor binding sequence when integrated at a DSB in the genome, is operably linked. Embodiments of transcription factors include hormone receptors, e. g., nuclear receptors, which include both a hormone-binding domain and a DNA-binding domain; in embodiments, the polynucleotide donor molecule that is integrated (or that has a sequence that is integrated) at the site of at least one double-strand break (DSB) in a genome includes or encodes a hormone-binding domain of a nuclear receptor or a DNA-binding domain of a nuclear receptor. Various non-limiting examples of transcription factor binding sequences and transcription factors are provided in the working Examples. In embodiments, the sequence recognizable by a specific binding agent is a transcription factor binding sequence selected from those publicly disclosed at *Arabidopsis*[dot]med[dot]ohio-state[dot]edu/AtcisDB/bindingsites[dot]html and neomorph[dot]salk[dot]edu/dap_web/pages/index[dot]php.

To summarize, the methods described herein permit sequences encoded by donor polynucleotides to be inserted, in a non-multiplexed or multiplexed manner, into a plant cell genome for the purpose of modulating gene expression in a number of distinct ways. Gene expression can be modulated up or down, for example, by tuning expression through the insertion of enhancer elements and transcription start sequences (e.g., nitrate response elements and auxin binding elements). Conditional transcription factor binding sites can be added or modified to allow additional control. Similarly, transcript stabilizing and/or destabilizing sequences can be inserted using the methods herein. Via the targeted insertion of stop codons, RNAi cleavage sites, or sites for recombinases, the methods described herein allow the transcription of particular sequences to be selectively turned off (likewise, the targeted removal of such sequences can be used to turn gene transcription on).

The plant genome targeting methods disclosed herein also enable transcription rates to be adjusted by the modification (optimization or de-optimization) of core promoter sequences (e.g., TATAA boxes). Proximal control elements (e.g., GC boxes; CAAT boxes) can likewise be modified. Enhancer or repressor motifs can be inserted or modified. Three-dimensional structural barriers in DNA that inhibit RNA polymerase can be created or removed via the targeted insertion of sequences, or by the modification of existing sequences. Where intron mediated enhancement is known to affect transcript rate, the relevant rate-affecting sequences can be optimized or de-optimized (by insertion of additional sequences or modification of existing sequences) to further enhance or diminish transcription. Through the insertion or modification of sequences using the targeting methods described herein (including multiplexed targeting methods), mRNA stability and processing can be modulated (thereby modulating gene expression). For example, mRNA stabilizing or destabilizing motifs can be inserted, removed or modified; mRNA splicing donor/acceptor sites can be inserted, removed or modified and, in some instance, create the possibility of increased control over alternate splicing. Similarly, miRNA binding sites can be added, removed or modified using the methods described herein. Epigenetic regulation of transcription can also be adjusted according to the methods described herein (e.g., by increasing or decreasing the degree of methylation of DNA, or the degree of methylation or acetylation of histones). Epigenetic regulation using the tools and methods described herein can be combined with other methods for modifying genetic sequences described herein, for the purpose of modifying a trait of a plant cell or plant, or for creating populations of modified cells and cells from which desired phenotypes can be selected.

The plant genome targeting methods described herein can also be used to modulate translation efficiency by, e.g., modifying codon usage towards or away from a particular plant cell's bias. Similarly, through the use of the targeting methods described herein, KOZAK sequences can be optimized or deoptimized, mRNA folding and structures affecting initiation of translation can be altered, and upstream reading frames can be created or destroyed. Through alteration of coding sequences using the targeted genome modification methods described herein, the abundance and/or activity of translated proteins can be adjusted. For example, the amino acid sequences in active sites or functional sites of proteins can be modified to increase or decrease the activity of the protein as desired; in addition, or alternatively, protein stabilizing or destabilizing motifs can be added or modified. All of the gene expression and activity modification schemes described herein can be utilized in various combinations to fine-tune gene expression and activity. Using the multiplexed targeting methods described herein, a plurality of specific targeted modifications can be achieved in a plant cell without intervening selection or sequencing steps.

Modified Plant Cells Comprising Specifically Targeted and Modified Genomes

Another aspect of the invention includes the cell, such as a plant cell, provided by the methods disclosed herein. In an embodiment, a plant cell thus provided includes in its genome a heterologous DNA sequence that includes: (a) nucleotide sequence of a polynucleotide (such as a double-stranded DNA, a single-stranded DNA, a single-stranded DNA/RNA hybrid, or a double-stranded DNA/RNA hybrid) molecule integrated at the site of a DSB in a genome; and (b) genomic nucleotide sequence adjacent to the site of the DSB. In embodiments, the methods disclosed herein for integrating a sequence encoded by a polynucleotide donor molecule into the site of a DSB are applied to a plant cell (e.g., a plant cell or plant protoplast isolated from a whole plant or plant part or plant tissue, or an isolated plant cell or plant protoplast in suspension or plate culture); in other embodiments, the methods are applied to non-isolated plant cells in situ or in planta, such as a plant cell located in an intact or growing plant or in a plant part or tissue. The methods disclosed herein for integrating a sequence encoded by a polynucleotide donor molecule into the site of a DSB are also useful in introducing heterologous sequence at the site of a DSB induced in the genome of other photosynthetic eukaryotes (e.g., green algae, red algae, diatoms, brown algae, and dinoflagellates). In embodiments, the plant cell or plant protoplast is capable of division and further differentiation. In embodiments, the plant cell or plant protoplast is obtained or isolated from a plant or part of a plant selected from the group consisting of a plant tissue, a whole plant, an intact nodal bud, a shoot apex or shoot apical meristem, a root apex or root apical meristem, lateral meristem, intercalary meristem, a seedling (e.g., a germinating seed or small seedling or a larger seedling with one or more true leaves), a whole seed (e.g., an intact seed, or a seed with part or all of its seed coat removed or treated to make permeable), a halved seed or other seed fragment, a zygotic or somatic embryo (e.g., a mature dissected zygotic embryo, a developing zygotic or somatic embryo, a dry or rehydrated or freshly excised zygotic embryo), pollen, microspores, epidermis, flower, and callus.

In some embodiments, the method includes the additional step of growing or regenerating a plant from a plant cell containing the heterologous DNA sequence of the polynucleotide donor molecule integrated at the site of a DSB and genomic nucleotide sequence adjacent to the site of the DSB, wherein the plant includes at least some cells that contain the heterologous DNA sequence of the polynucleotide donor molecule integrated at the site of a DSB and genomic nucleotide sequence adjacent to the site of the DSB. In embodiments, callus is produced from the plant cell, and plantlets and plants produced from such callus. In other embodiments, whole seedlings or plants are grown directly from the plant cell without a callus stage. Thus, additional related aspects are directed to whole seedlings and plants grown or regenerated from the plant cell or plant protoplast containing sequence encoded by a polynucleotide (such as a double-stranded DNA, a single-stranded DNA, a single-stranded DNA/RNA hybrid, or a double-stranded DNA/RNA hybrid) donor molecule heterologously integrated at the site of a DSB, as well as the seeds of such plants; embodiments include whole seedlings and plants grown or regenerated from the plant cell or plant protoplast containing sequence encoded by a polynucleotide donor molecule heterologously integrated at the site of two or more DSBs, as well as the seeds of such plants. In embodiments, the grown or regenerated plant exhibits a phenotype associated with the sequence encoded by a polynucleotide donor molecule heterologously integrated at the site of a DSB. In embodiments, the grown or regenerated plant includes in its genome two or more genetic modifications that in combination provide at least one phenotype of interest, wherein at least one of the two or more genetic modifications includes the sequence encoded by a polynucleotide donor molecule heterologously integrated at the site of a DSB in the genome, or wherein the two or more genetic modifications include sequence encoded by at least one polynucleotide donor heterologously integrated at two or more DSBs in the genome, or wherein the two or more genetic modifications include sequences encoded by multiple polynucleotides donor molecules heterologously integrated at different DSBs in the genome. In embodiments, a heterogeneous population of plant cells or plant protoplasts, at least some of which include sequence encoded by at least one polynucleotide donor molecule heterologously integrated at the site of a DSB, is provided by the method; related aspects include a plant having a phenotype of interest associated with sequence encoded by the polynucleotide donor molecule heterologously integrated at the site of a DSB, provided by either regeneration of a plant having the phenotype of interest from a plant cell or plant protoplast selected from the heterogeneous population of plant cells or plant protoplasts, or by selection of a plant having the phenotype of interest from a heterogeneous population of plants grown or regenerated from the population of plant cells or plant protoplasts. Examples of phenotypes of interest include (but are not limited to) herbicide resistance; improved tolerance of abiotic stress (e. g., tolerance of temperature extremes, drought, or salt) or biotic stress (e. g., resistance to bacterial or fungal pathogens); improved utilization of nutrients or water; synthesis of new or modified amounts of lipids, carbohydrates, proteins or other chemicals, including medicinal compounds; improved flavour or appearance; improved photosynthesis; improved storage characteristics (e. g., resistance to bruising, browning, or softening); increased yield; altered morphology (e. g., floral architecture or colour, plant height, branching, root structure); and changes in flowering time. In an embodiment, a heterogeneous population of plant cells or plant protoplasts (or seedlings or plants grown or regenerated therefrom) is exposed to conditions permitting expression of the phenotype of interest; e. g., selection for herbicide resistance can include exposing the population of plant cells or plant protoplasts (or seedlings or plants) to an amount of herbicide or other substance that inhibits growth or is toxic, allowing identification and selection of those resistant plant cells or plant protoplasts (or seedlings or plants) that survive treatment. In certain embodiments, a proxy measurement can be taken of an aspect of a modified plant or plant cell, where the measurement is indicative of a desired phenotype or trait. For example, the modification of one or more targeted sequences in a genome may provide a measurable change in a molecule (e.g., a detectable change in the structure of a molecule, or a change in the amount of the molecule that is detected, or the presence or absence of a molecule) that can be used as a biomarker for a presence of a desired phenotype or trait. The proper insertion of an enhancer for increasing expression of an enzyme, for example, may be determined by detecting lower levels of the enzyme's substrate.

In some embodiments, modified plants are produced from cells modified according to the methods described herein without a tissue culturing step. In certain embodiments, the modified plant cell or plant does not have significant losses of methylation compared to a non-modified parent plant cell or plant. For example, the modified plant lacks significant losses of methylation in one or more promoter regions relative to the parent plant cell or plant. Similarly, in certain embodiments, an modified plant or plant cell obtained using the methods described herein lacks significant losses of methylation in protein coding regions relative to the parent cell or parent plant before modification using the modifying methods described herein.

Also contemplated are new heterogeneous populations, arrays, or libraries of plant cells and plants created by the introduction of targeted modifications at one more locations in the genome. Plant compositions of the invention include succeeding generations or seeds of modified plants that are grown or regenerated from plant cells or plant protoplasts modified according to the methods herein, as well as parts of those plants (including plant parts used in grafting as scions or rootstocks), or products (e. g., fruits or other edible plant parts, cleaned grains or seeds, edible oils, flours or starches, proteins, and other processed products) made from these plants or their seeds. Embodiments include plants grown or regenerated from the plant cells or plant protoplasts, wherein the plants contain cells or tissues that do not have sequence encoded by the polynucleotide donor molecule heterologously integrated at the site of a DSB, e. g., grafted plants in which the scion or rootstock contains sequence encoded by the polynucleotide donor molecule heterologously integrated at the site of a DSB, or chimeric plants in which some but not all cells or tissues contain sequence encoded by the polynucleotide donor molecule heterologously integrated at the site of a DSB. Plants in which grafting is commonly useful include many fruit trees and plants such as many citrus trees, apples, stone fruit (e. g., peaches, apricots, cherries, and plums), avocados, tomatoes, eggplant, cucumber, melons, watermelons, and grapes as well as various ornamental plants such as roses. Grafted plants can be grafts between the same or different (generally related) species. Additional related aspects include (a) a hybrid plant provided by crossing a first plant grown or regenerated from a plant cell or plant protoplast with sequence encoded by at least one polynucleotide donor molecule heterologously integrated at the site of a DSB, with a second plant, wherein the hybrid plant contains sequence encoded by the polynucleotide donor molecule heterologously integrated at the site of a DSB, and (b) a hybrid plant provided by crossing a first plant grown or regenerated from a plant cell or plant protoplast with sequence encoded by at least one polynucleotide donor molecule heterologously integrated at multiple DSB sites, with a second plant, wherein the hybrid plant contains sequence encoded by at least one polynucleotide donor molecule heterologously integrated at the site of at least one DSB; also contemplated is seed produced by the hybrid plant. Also envisioned as related aspects are progeny seed and progeny plants, including hybrid seed and hybrid plants, having the regenerated plant as a parent or ancestor. In embodiments, the plant cell (or the regenerated plant, progeny seed, and progeny plant) is diploid or polyploid. In embodiments, the plant cell (or the regenerated plant, progeny seed, and progeny plant) is haploid or can be induced to become haploid; techniques for making and using haploid plants and plant cells are known in the art, see, e. g., methods for generating haploids in *Arabidopsis thaliana* by crossing of a wild-type strain to a haploid-inducing strain that expresses altered forms of the centromere-specific histone CENH3, as described by Maruthachalam and Chan in "How to make haploid *Arabidopsis thaliana*", a protocol publicly available at www[dot]openwetware[dot]org/images/d/d3/ Haploid_*Arabidopsis*_protocol[dot]pdf, Ravi et al. (2014) *Nature Communications*, 5:5334, doi: 10.1038/ ncomms6334). Examples of haploid cells include but are not limited to plant cells obtained from haploid plants and plant cells obtained from reproductive tissues, e. g., from flowers, developing flowers or flower buds, ovaries, ovules, megaspores, anthers, pollen, and microspores. In embodiments where the plant cell is haploid, the method can further include the step of chromosome doubling (e. g., by spontaneous chromosomal doubling by meiotic non-reduction, or by using a chromosome doubling agent such as colchicine, oryzalin, trifluralin, pronamide, nitrous oxide gas, antimicrotubule herbicides, anti-microtubule agents, and mitotic inhibitors) in the plant cell containing heterologous DNA sequence (i. e. sequence of the polynucleotide donor molecule integrated at the site of a DSB in the genome and genomic nucleotide sequence adjacent to the site of the DSB) to produce a doubled haploid plant cell or plant protoplast that is homozygous for the heterologous DNA sequence; yet other embodiments include regeneration of a doubled haploid plant from the doubled haploid plant cell or plant protoplast, wherein the regenerated doubled haploid plant is homozygous for the heterologous DNA sequence. Thus, aspects of the invention are related to the haploid plant cell or plant protoplast having the heterologous DNA sequence of the polynucleotide donor molecule integrated at the site of a DSB and genomic nucleotide sequence adjacent to the site of the DSB, as well as a doubled haploid plant cell or plant protoplast or a doubled haploid plant that is homozygous for the heterologous DNA sequence. Another aspect of the invention is related to a hybrid plant having at least one parent plant that is a doubled haploid plant provided by the method. Production of doubled haploid plants by these methods provides homozygosity in one generation, instead of requiring several generations of self-crossing to obtain homozygous plants; this may be particularly advantageous in slow-growing plants, such as fruit and other trees, or for producing hybrid plants that are offspring of at least one doubled-haploid plant.

Plants and plant cells that may be modified according to the methods described herein are of any species of interest, including dicots and monocots, but especially tomato species (including hybrid species).

The tomato cells and derivative plants and seeds disclosed herein can be used for various purposes useful to the consumer or grower. The intact plant itself may be desirable, e. g., plants grown as cover crops or as ornamentals. In other embodiments, processed products are made from the plant or its seeds, such as extracted proteins, oils, sugars, and starches, fermentation products, animal feed or human food, wood and wood products, pharmaceuticals, and various industrial products. Thus, further related aspects of the invention include a processed or commodity product made from a plant or seed or plant part that includes at least some cells that contain the heterologous DNA sequence including the sequence encoded by the polynucleotide donor molecule integrated at the site of a DSB and genomic nucleotide sequence adjacent to the site of the DSB. Commodity products include, but are not limited to, harvested leaves, roots, shoots, tubers, stems, fruits, seeds, or other parts of a plant, meals, oils (edible or inedible), fiber, extracts, fermentation or digestion products, crushed or whole grains or seeds of a plant, wood and wood pulp, or any food or non-food product. Detection of a heterologous DNA sequence that includes: (a) nucleotide sequence encoded by a polynucleotide donor molecule integrated at the site of a DSB in a genome; and (b) genomic nucleotide sequence adjacent to the site of the DSB in such a commodity product is de facto evidence that the commodity product contains or is derived from a plant cell, plant, or seed of this invention.

In another aspect, the invention provides a heterologous nucleotide sequence including: (a) nucleotide sequence encoded by a polynucleotide donor molecule integrated by the methods disclosed herein at the site of a DSB in a genome, and (b) genomic nucleotide sequence adjacent to the site of the DSB. Related aspects include a plasmid, vector, or chromosome including such a heterologous nucleotide sequence, as well as polymerase primers for amplification (e. g., PCR amplification) of such a heterologous nucleotide sequence.

Compositions and Reaction Mixtures

In one aspect, the invention provides a composition including: (a) a cell; and (b) a polynucleotide (such as a double-stranded DNA, a single-stranded DNA, a single-stranded DNA/RNA hybrid, or a double-stranded DNA/ RNA hybrid) donor molecule that is capable of being integrated (or having its sequence integrated) (preferably by non-homologous end-joining (NHEJ)) at one or more double-strand breaks in a genome in the cell. In many embodiments of the composition, the cell is a plant cell, e. g., an isolated plant cell or a plant protoplast, or a plant cell in a plant, plant part, plant tissue, or callus. In certain embodiments, the cell is that of a photosynthetic eukaryote (e. g., green algae, red algae, diatoms, brown algae, and dinoflagellates).

In various embodiments of the composition, the plant cell is a plant cell or plant protoplast isolated from a whole plant or plant part or plant tissue (e. g., a plant cell or plant protoplast cultured in liquid medium or on solid medium), or a plant cell located in callus, an intact plant, seed, or seedling, or in a plant part or tissue. In embodiments, the plant cell is a cell of a monocot plant or of a dicot plant. In many embodiments, the plant cell is a plant cell capable of division and/or differentiation, including a plant cell capable of being regenerated into callus or a plant. In embodiments, the plant cell is capable of division and further differentiation, even capable of being regenerated into callus or into a plant. In embodiments, the plant cell is diploid, polyploid, or haploid (or can be induced to become haploid).

In embodiments, the composition includes a plant cell that includes at least one double-strand break (DSB) in its genome. Alternatively, the composition includes a plant cell in which at least one DSB will be induced in its genome, for example, by providing at least one DSB-inducing agent to the plant cell, e. g., either together with the polynucleotide (such as a double-stranded DNA, a single-stranded DNA, a single-stranded DNA/RNA hybrid, or a double-stranded DNA/RNA hybrid) donor molecule or separately. Thus, the composition optionally further includes at least one DSB-inducing agent. In embodiments, the composition optionally further includes at least one chemical, enzymatic, or physical delivery agent, or a combination thereof, such delivery agents and methods for their use are described in detail in the paragraphs following the heading "Delivery Methods and Delivery Agents". In embodiments, the DSB-inducing agent is at least one of the group consisting of:
 (a) a nuclease selected from the group consisting of an RNA-guided nuclease, an RNA-guided DNA endonuclease, a type II Cas nuclease, a Cas9, a type V Cas nuclease, a Cpf1, a CasY, a CasX, a C2c1, a C2c3, an engineered nuclease, a codon-optimized nuclease, a zinc-finger nuclease (ZFN), a transcription activator-like effector nuclease (TAL-effector nuclease), an Argonaute, and a meganuclease or engineered meganuclease;
 (b) a polynucleotide encoding one or more nucleases capable of effecting site-specific alteration (such as introduction of a DSB) of a target nucleotide sequence; and
 (c) a guide RNA (gRNA) for an RNA-guided nuclease, or a DNA encoding a gRNA for an RNA-guided nuclease.

In embodiments, the composition includes (a) a cell; (b) a polynucleotide (such as a double-stranded DNA, a single-stranded DNA, a single-stranded DNA/RNA hybrid, or a double-stranded DNA/RNA hybrid) donor molecule, capable of being integrated (or having its sequence integrated) at a DSB; (c) a Cas9, a Cpf1, a CasY, a CasX, a C2c1, or a C2c3 nuclease; and (d) at least one guide RNA. In an embodiment, the composition includes (a) a cell; (b) a polynucleotide (such as a double-stranded DNA, a single-stranded DNA, a single-stranded DNA/RNA hybrid, or a double-stranded DNA/RNA hybrid) donor molecule, capable of being integrated (or having its sequence integrated) at a DSB; (c) at least one ribonucleoprotein including a CRISPR nuclease and a guide RNA.

In embodiments of the composition, the polynucleotide donor molecule is double-stranded and blunt-ended, or is double stranded and has an overhang or "sticky end" consisting of unpaired nucleotides (e. g., 1, 2, 3, 4, 5, or 6 unpaired nucleotides) at one terminus or both termini; in other embodiments, the polynucleotide donor molecule is a single-stranded DNA or a single-stranded DNA/RNA hybrid. In an embodiment, the polynucleotide donor molecule is a double-stranded DNA or DNA/RNA hybrid molecule that is blunt-ended or that has an overhang at one terminus or both termini, and that has about 18 to about 300 base-pairs, or about 20 to about 200 base-pairs, or about 30 to about 100 base-pairs, and having at least one phosphorothioate bond between adjacent nucleotides at a 5' end, 3' end, or both 5' and 3' ends. In embodiments, the polynucleotide donor molecule is a double-stranded DNA, a single-stranded DNA, a single-stranded DNA/RNA hybrid, or a double-stranded DNA/RNA hybrid, and includes single strands of at least 11, at least 18, at least 20, at least 30, at least 40, at least 60, at least 80, at least 100, at least 120, at least 140, at least 160, at least 180, at least 200, at least 240, at least 280, or at least 320 nucleotides. In embodiments, the polynucleotide donor molecule includes chemically modified nucleotides; in embodiments, the naturally occurring phosphodiester backbone of the polynucleotide molecule is partially or completely modified with phosphorothioate, phosphorodithioate, or methylphosphonate internucleotide linkage modifications, or the polynucleotide donor molecule includes modified nucleoside bases or modified sugars, or the polynucleotide donor molecule is labelled with a fluorescent moiety or other detectable label. In an embodiment, the polynucleotide donor molecule is double-stranded and perfectly base-paired through all or most of its length, with the possible exception of any unpaired nucleotides at either terminus or both termini. In another embodiment, the polynucleotide donor molecule is double-stranded and includes one or more non-terminal mismatches or non-terminal unpaired nucleotides within the otherwise double-stranded duplex. Other related embodiments include single- or double-stranded DNA/RNA hybrid donor molecules. Additional description of the polynucleotide donor molecule is found above in the paragraphs following the heading "Polynucleotide Molecules".

In embodiments of the composition, the polynucleotide donor molecule includes:
 (a) a nucleotide sequence that is recognizable by a specific binding agent;
 (b) a nucleotide sequence encoding an RNA molecule or an amino acid sequence that is recognizable by a specific binding agent;
 (c) a nucleotide sequence that encodes an RNA molecule or an amino acid sequence that binds specifically to a ligand;
 (d) a nucleotide sequence that is responsive to a specific change in the physical environment; or
 (e) a nucleotide sequence encoding an RNA molecule or an amino acid sequence that is responsive to a specific change in the physical environment;
 (f) a nucleotide sequence encoding at least one stop codon on each strand;
 (g) a nucleotide sequence encoding at least one stop codon within each reading frame on each strand; or
 (h) at least partially self-complementary sequence, such that the polynucleotide molecule encodes a transcript that is capable of forming at least partially double-stranded RNA; or
 (i) a combination of any of (a)-(h).

Additional description relating to these various embodiments of nucleotide sequences included in the polynucleotide donor molecule is found in the section headed "Methods of changing expression of a sequence of interest in a genome".

In another aspect, the invention provides a reaction mixture including: (a) a plant cell having a double-strand break (DSB) at least one locus in its genome; and (b) a polynucleotide (such as a double-stranded DNA, a single-stranded DNA, a single-stranded DNA/RNA hybrid, or a double-stranded DNA/RNA hybrid) donor molecule capable of being integrated or inserted (or having its sequence integrated or inserted) at the DSB (preferably by non-homologous end-joining (NHEJ)), with a length of between about 18 to about 300 base-pairs (or nucleotides, if single-stranded), or between about 30 to about 100 base-pairs (or nucleotides, if single-stranded); wherein sequence encoded by the polynucleotide donor molecule, if integrated at the DSB, forms a heterologous insertion (that is to say, resulting in a concatenated nucleotide sequence that is a combination of the sequence of the polynucleotide molecule and at least some of the genomic sequence adjacent to the site of DSB, wherein the concatenated sequence is heterologous, i. e., would not otherwise or does not normally occur at the site of insertion). In embodiments, the product of the reaction mixture includes a plant cell in which sequence encoded by the polynucleotide donor molecule has been integrated at the site of the DSB.

In many embodiments of the reaction mixture, the cell is a plant cell, e. g., an isolated plant cell or a plant protoplast, or a plant cell in a plant, plant part, plant tissue, or callus. In various embodiments of the reaction mixture, the plant cell is a plant cell or plant protoplast isolated from a whole plant or plant part or plant tissue (e. g., a plant cell or plant protoplast cultured in liquid medium or on solid medium), or a plant cell located in callus, an intact plant, seed, or seedling, or in a plant part or tissue. In embodiments, the plant cell is a cell of a monocot plant or of a dicot plant. In many embodiments, the plant cell is a plant cell capable of division and/or differentiation, including a plant cell capable of being regenerated into callus or a plant. In embodiments, the plant cell is capable of division and further differentiation, even capable of being regenerated into callus or into a plant. In embodiments, the plant cell is diploid, polyploid, or haploid (or can be induced to become haploid).

In embodiments, the reaction mixture includes a plant cell that includes at least one double-strand break (DSB) in its genome. Alternatively, the reaction mixture includes a plant cell in which at least one DSB will be induced in its genome, for example, by providing at least one DSB-inducing agent to the plant cell, e. g., either together with a polynucleotide (such as a double-stranded DNA, a single-stranded DNA, a single-stranded DNA/RNA hybrid, or a double-stranded DNA/RNA hybrid) donor molecule capable of being integrated or inserted (or having its sequence integrated or inserted) at the DSB, or separately. Thus, the reaction mixture optionally further includes at least one DSB-inducing agent. In embodiments, the reaction mixture optionally further includes at least one chemical, enzymatic, or physical delivery agent, or a combination thereof, such delivery agents and methods for their use are described in detail in the paragraphs following the heading "Delivery Methods and Delivery Agents". In embodiments, the DSB-inducing agent is at least one of the group consisting of:
  (a) a nuclease selected from the group consisting of an RNA-guided nuclease, an RNA-guided DNA endonuclease, a type II Cas nuclease, a Cas9, a type V Cas nuclease, a Cpf1, a CasY, a CasX, a C2c1, a C2c3, an engineered nuclease, a codon-optimized nuclease, a zinc-finger nuclease (ZFN), a transcription activator-like effector nuclease (TAL-effector nuclease), an Argonaute, and a meganuclease or engineered meganuclease;
  (b) a polynucleotide encoding one or more nucleases capable of effecting site-specific alteration (such as introduction of a DSB) of a target nucleotide sequence; and
  (c) a guide RNA (gRNA) for an RNA-guided nuclease, or a DNA encoding a gRNA for an RNA-guided nuclease.

In embodiments, the reaction mixture includes (a) a plant cell; (b) a polynucleotide (such as a double-stranded DNA, a single-stranded DNA, a single-stranded DNA/RNA hybrid, or a double-stranded DNA/RNA hybrid) donor molecule capable of being integrated or inserted (or having its sequence integrated or inserted) at the DSB; (c) a Cas9, a Cpf1, a CasY, a CasX, a C2c1, or a C2c3 nuclease; and (d) at least one guide RNA. In an embodiment, the reaction mixture includes (a) a plant cell or a plant protoplast; (b) a polynucleotide (such as a double-stranded DNA, a single-stranded DNA, a single-stranded DNA/RNA hybrid, or a double-stranded DNA/RNA hybrid) donor molecule capable of being integrated or inserted (or having its sequence integrated or inserted) at the DSB; (c) at least one ribonucleoprotein including a CRISPR nuclease and a guide RNA. In an embodiment, the reaction mixture includes (a) a plant cell or a plant protoplast; (b) a polynucleotide (such as a double-stranded DNA, a single-stranded DNA, a single-stranded DNA/RNA hybrid, or a double-stranded DNA/RNA hybrid) donor molecule capable of being integrated or inserted (or having its sequence integrated or inserted) at the DSB; (c) at least one ribonucleoprotein including Cas9 and an sgRNA.

In embodiments of the reaction mixture, the polynucleotide (such as a double-stranded DNA, a single-stranded DNA, a single-stranded DNA/RNA hybrid, or a double-stranded DNA/RNA hybrid) donor molecule includes:
  (a) a nucleotide sequence that is recognizable by a specific binding agent;
  (b) a nucleotide sequence encoding an RNA molecule or an amino acid sequence that is recognizable by a specific binding agent;
  (c) a nucleotide sequence that encodes an RNA molecule or an amino acid sequence that binds specifically to a ligand;
  (d) a nucleotide sequence that is responsive to a specific change in the physical environment; or
  (e) a nucleotide sequence encoding an RNA molecule or an amino acid sequence that is responsive to a specific change in the physical environment;
  (f) a nucleotide sequence encoding at least one stop codon on each strand;
  (g) a nucleotide sequence encoding at least one stop codon within each reading frame on each strand; or
  (h) at least partially self-complementary sequence, such that the polynucleotide molecule encodes a transcript that is capable of forming at least partially double-stranded RNA; or
  (i) a combination of any of (a)-(h).

Additional description relating to these various embodiments of nucleotide sequences included in the polynucleotide donor molecule is found in the section headed "Methods of changing expression of a sequence of interest in a genome".

Polynucleotides for Disrupting Gene Expression

In another aspect, the invention provides a polynucleotide (such as a double-stranded DNA, a single-stranded DNA, a single-stranded DNA/RNA hybrid, or a double-stranded DNA/RNA hybrid) molecule for disrupting gene expression, including double-stranded polynucleotides containing at least 18 base-pairs and encoding at least one stop codon in each possible reading frame on each strand and single-stranded polynucleotides containing at least 11 contiguous nucleotides and encoding at least one stop codon in each possible reading frame on the strand. Such a stop-codon-containing polynucleotide, when integrated or inserted at the site of a DSB in a genome, disrupts or hinders translation of an encoded amino acid sequence. In embodiments, the polynucleotide is a double-stranded DNA or double-stranded DNA/RNA hybrid molecule including at least 18 contiguous base-pairs and encoding at least one stop codon in each possible reading frame on either strand; in embodiments, the polynucleotide is a double-stranded DNA or double-stranded DNA/RNA hybrid molecule that is blunt-ended; in other embodiments, the polynucleotide is a double-stranded DNA or double-stranded DNA/RNA hybrid molecule that has one or more overhangs or unpaired nucleotides at one or both termini. In embodiments, the polynucleotide is double-stranded and includes between about 18 to about 300 nucleotides on each strand. In embodiments, the polynucleotide is a single-stranded DNA or a single-stranded DNA/RNA hybrid molecule including at least 11 contiguous nucleotides and encoding at least one stop codon in each possible reading frame on the strand. In embodiments, the polynucleotide is single-stranded and includes between 11 and about 300 contiguous nucleotides in the strand.

In embodiments, the polynucleotide for disrupting gene expression further includes a nucleotide sequence that provides a useful function when integrated into the site of a DSB in a genome. For example, in various non-limiting embodiments the polynucleotide further includes: sequence that is recognizable by a specific binding agent or that binds to a specific molecule or encodes an RNA molecule or an amino acid sequence that binds to a specific molecule, or sequence that is responsive to a specific change in the physical environment or encodes an RNA molecule or an amino acid sequence that is responsive to a specific change in the physical environment, or heterologous sequence, or sequence that serves to stop transcription at the site of the DSB, or sequence having secondary structure (e. g., double-stranded stems or stem-loops) or than encodes a transcript having secondary structure (e. g., double-stranded RNA that is cleavable by a Dicer-type ribonuclease).

In an embodiment, the polynucleotide for disrupting gene expression is a double-stranded DNA or a double-stranded DNA/RNA hybrid molecule, wherein each strand of the polynucleotide includes at least 18 and fewer than 200 contiguous base-pairs, wherein the number of base-pairs is not divisible by 3, and wherein each strand encodes at least one stop codon in each possible reading frame in the 5' to 3' direction. In an embodiment, the polynucleotide is a double-stranded DNA or a double-stranded DNA/RNA hybrid molecule, wherein the polynucleotide includes at least one phosphorothioate modification.

Related aspects include larger polynucleotides such as a plasmid, vector, or chromosome including the polynucleotide for disrupting gene expression, as well as polymerase primers for amplification of the polynucleotide for disrupting gene expression.

Methods of Identifying the Locus of a Double-Stranded Break

In another aspect, the invention provides a method of identifying the locus of at least one double-stranded break (DSB) in genomic DNA in a cell (such as a plant cell or plant protoplast) including the genomic DNA, the method including: (a) contacting the genomic DNA having a DSB with a polynucleotide (such as a double-stranded DNA, a single-stranded DNA, a single-stranded DNA/RNA hybrid, or a double-stranded DNA/RNA hybrid) molecule, wherein the polynucleotide donor molecule is capable of being integrated (or having its sequence integrated) at the DSB and has a length of at least 2, at least 3, at least 4, at least 5, at least 6, at least 7, at least 8, at least 9, at least 10, or at least 11 base-pairs if double-stranded (or nucleotides if single-stranded), or between about 2 to about 320 base-pairs if double-stranded (or nucleotides if single-stranded), or between about 2 to about 500 base-pairs if double-stranded (or nucleotides if single-stranded), or between about 5 to about 500 base-pairs if double-stranded (or nucleotides if single-stranded), or between about 5 to about 300 base-pairs if double-stranded (or nucleotides if single-stranded), or between about 11 to about 300 base-pairs if double-stranded (or nucleotides if single-stranded), or about 18 to about 300 base-pairs if double-stranded (or nucleotides if single-stranded), or between about 30 to about 100 base-pairs if double-stranded (or nucleotides if single-stranded); wherein sequence encoded by the polynucleotide donor molecule, if integrated at the DSB, forms a heterologous insertion; and (b) using at least part of the sequence encoded by the polynucleotide molecule as a target for PCR primers to allow amplification of DNA in the locus of the double-stranded break. In embodiments, the genomic DNA is that of a nucleus, mitochondrion, or plastid. In embodiments, the DSB locus is identified by amplification using primers specific for DNA sequence encoded by the polynucleotide molecule alone; in other embodiments, the DSB locus is identified by amplification using primers specific for a combination of DNA sequence encoded by the polynucleotide donor molecule and genomic DNA sequence flanking the DSB. Such identification using a heterologously integrated DNA sequence (i. e., that encoded by the polynucleotide molecule) is useful, e. g., to distinguish a cell (such as a plant cell or plant protoplast) containing sequence encoded by the polynucleotide molecule integrated at the DSB from a cell that does not. Identification of an edited genome from a non-edited genome is important for various purposes, e. g., for commercial or regulatory tracking of cells or biological material such as plants or seeds containing an edited genome.

In a related aspect, the invention provides a method of identifying the locus of double-stranded breaks (DSBs) in genomic DNA in a pool of cells (such as a pool of plant cells or plant protoplasts), wherein the pool of cells includes cells having genomic DNA with sequence encoded by a polynucleotide (such as a double-stranded DNA, a single-stranded DNA, a single-stranded DNA/RNA hybrid, or a double-stranded DNA/RNA hybrid) donor molecule inserted at the locus of the double stranded breaks; wherein the polynucleotide donor molecule is capable of being integrated (or having its sequence integrated) at the DSB and has a length of at least 2, at least 3, at least 4, at least 5, at least 6, at least 7, at least 8, at least 9, at least 10, or at least 11 base-pairs if double-stranded (or nucleotides if single-stranded), or between about 2 to about 320 base-pairs if double-stranded (or nucleotides if single-stranded), or between about 2 to about 500 base-pairs if double-stranded (or nucleotides if single-stranded), or between about 5 to about 500 base-pairs if double-stranded (or nucleotides if single-stranded), or between about 5 to about 300 base-pairs if double-stranded (or nucleotides if single-stranded), or between about 11 to about 300 base-pairs if double-stranded (or nucleotides if single-stranded), or about 18 to about 300 base-pairs if double-stranded (or nucleotides if single-stranded), or between about 30 to about 100 base-pairs if double-stranded (or nucleotides if single-stranded); wherein sequence encoded by the polynucleotide donor molecule, if integrated at the DSB, forms a heterologous insertion; wherein the sequence encoded by the polynucleotide molecule is used as a target for PCR primers to allow amplification of DNA in the region of the double-stranded breaks. In embodiments, the genomic DNA is that of a nucleus, mitochondrion, or plastid. In embodiments, the pool of cells is a population of plant cells or plant protoplasts, wherein the population of plant cells or plant protoplasts include multiple different DSBs (e. g., induced by different guide RNAs) in the genome. In embodiments, each DSB locus is identified by amplification using primers specific for DNA sequence encoded by the polynucleotide molecule alone; in other embodiments, each DSB locus is identified by amplification using primers specific for a combination of DNA sequence encoded by the polynucleotide molecule and genomic DNA sequence flanking the DSB. Such identification using a heterologously integrated DNA sequence (i. e., sequence encoded by the polynucleotide molecule) is useful, e. g., to identify a cell (such as a plant cell or plant protoplast) containing sequence encoded by the polynucleotide molecule integrated at a DSB from a cell that does not.

In embodiments, the pool of cells is a pool of isolated plant cells or plant protoplasts in liquid or suspension culture, or cultured in or on semi-solid or solid media. In embodiments, the pool of cells is a pool of plant cells or plant protoplasts encapsulated in a polymer or other encapsulating material, enclosed in a vesicle or liposome, or embedded in or attached to a matrix or other solid support (e. g., beads or microbeads, membranes, or solid surfaces). In embodiments, the pool of cells is a pool of plant cells or plant protoplasts encapsulated in a polysaccharide (e. g., pectin, agarose). In embodiments, the pool of cells is a pool of plant cells located in a plant, plant part, or plant tissue, and the cells are optionally isolated from the plant, plant part, or plant tissue in a step following the integration of a polynucleotide at a DSB.

In embodiments, the polynucleotide donor molecule that is integrated (or has sequence that is integrated) at the DSB is double-stranded and blunt-ended; in other embodiments the polynucleotide donor molecule is double-stranded and has an overhang or "sticky end" consisting of unpaired nucleotides (e. g., 1, 2, 3, 4, 5, or 6 unpaired nucleotides) at one terminus or both termini. In an embodiment, the polynucleotide donor molecule that is integrated (or has sequence that is integrated) at the DSB is a double-stranded DNA or double-stranded DNA/RNA hybrid molecule of about 18 to about 300 base-pairs, or about 20 to about 200 base-pairs, or about 30 to about 100 base-pairs, and having at least one phosphorothioate bond between adjacent nucleotides at a 5' end, 3' end, or both 5' and 3' ends. In embodiments, the polynucleotide donor molecule includes single strands of at least 11, at least 18, at least 20, at least 30, at least 40, at least 60, at least 80, at least 100, at least 120, at least 140, at least 160, at least 180, at least 200, at least 240, at least 280, or at least 320 nucleotides. In embodiments, the polynucleotide donor molecule has a length of at least 2, at least 3, at least 4, at least 5, at least 6, at least 7, at least 8, at least 9, at least 10, or at least 11 base-pairs if double-stranded (or nucleotides if single-stranded), or between about 2 to about 320 base-pairs if double-stranded (or nucleotides if single-stranded), or between about 2 to about 500 base-pairs if double-stranded (or nucleotides if single-stranded), or between about 5 to about 500 base-pairs if double-stranded (or nucleotides if single-stranded), or between about 5 to about 300 base-pairs if double-stranded (or nucleotides if single-stranded), or between about 11 to about 300 base-pairs if double-stranded (or nucleotides if single-stranded), or about 18 to about 300 base-pairs if double-stranded (or nucleotides if single-stranded), or between about 30 to about 100 base-pairs if double-stranded (or nucleotides if single-stranded). In embodiments, the polynucleotide donor molecule includes chemically modified nucleotides; in embodiments, the naturally occurring phosphodiester backbone of the polynucleotide donor molecule is partially or completely modified with phosphorothioate, phosphorodithioate, or methylphosphonate internucleotide linkage modifications, or the polynucleotide donor molecule includes modified nucleoside bases or modified sugars, or the polynucleotide donor molecule is labelled with a fluorescent moiety or other detectable label. In an embodiment, the polynucleotide donor molecule is double-stranded and is perfectly base-paired through all or most of its length, with the possible exception of any unpaired nucleotides at either terminus or both termini. In another embodiment, the polynucleotide donor molecule is double-stranded and includes one or more non-terminal mismatches or non-terminal unpaired nucleotides within the otherwise double-stranded duplex. In related embodiments, the polynucleotide donor molecule that is integrated at the DSB is a single-stranded DNA or a single-stranded DNA/RNA hybrid. Additional description of the polynucleotide donor molecule is found above in the paragraphs following the heading "Polynucleotide Molecules".

In embodiments, the polynucleotide (such as a double-stranded DNA, a single-stranded DNA, a single-stranded DNA/RNA hybrid, or a double-stranded DNA/RNA hybrid) donor molecule that is integrated at the DSB includes a nucleotide sequence that, if integrated (or has sequence that is integrated) at the DSB, forms a heterologous insertion that is not normally found in the genome. In embodiments, sequence encoded by the polynucleotide molecule that is integrated at the DSB includes a nucleotide sequence that does not normally occur in the genome containing the DSB; this can be established by sequencing of the genome, or by hybridization experiments. In certain embodiments, sequence encoded by the polynucleotide molecule, when integrated at the DSB, not only permits identification of the locus of the DSB, but also imparts a functional trait to the cell including the genomic DNA, or to an organism including the cell; in non-limiting examples, sequence encoded by the polynucleotide molecule that is integrated at the DSB includes at least one of the nucleotide sequences selected from the group consisting of:
 (a) DNA encoding at least one stop codon, or at least one stop codon on each strand, or at least one stop codon within each reading frame on each strand;
 (b) DNA encoding heterologous primer sequence (e. g., a sequence of about 18 to about 22 contiguous nucleotides, or of at least 18, at least 20, or at least 22 contiguous nucleotides that can be used to initiate DNA polymerase activity at the site of the DSB);
 (c) DNA encoding a unique identifier sequence (e. g., a sequence that when inserted at the DSB creates a heterologous sequence that can be used to identify the presence of the insertion); (d) DNA encoding a transcript-stabilizing sequence;
 (e) DNA encoding a transcript-destabilizing sequence;
 (f) a DNA aptamer or DNA encoding an RNA aptamer or amino acid aptamer; and
 (g) DNA that includes or encodes a sequence recognizable by a specific binding agent.

Methods of Identifying the Nucleotide Sequence of a Locus in the Genome that is Associated with a Phenotype In another aspect, the invention provides a method of identifying the nucleotide sequence of a locus in the genome that is associated with a phenotype, the method including the steps of:
 (a) providing to a population of cells (such as plant cells or plant protoplasts) having the genome:
  (i) multiple different guide RNAs (gRNAs) to induce multiple different double strand breaks (DSBs) in the genome, wherein each DSB is produced by an RNA-guided nuclease guided to a locus on the genome by one of the gRNAs, and
  (ii) polynucleotide (such as a double-stranded DNA, a single-stranded DNA, a single-stranded DNA/RNA hybrid, or a double-stranded DNA/RNA hybrid) donor molecules having a defined nucleotide sequence, wherein the polynucleotide molecules are capable of being integrated (or have sequence that is integrated) into the DSBs by non-homologous end-joining (NHEJ);
 whereby when sequence encoded by at least some of the polynucleotide molecules are inserted into at least some of the DSBs, a genetically heterogeneous population of cells is produced;
 (b) selecting from the genetically heterogeneous population of cells a subset of cells that exhibit a phenotype of interest;

(c) using a pool of PCR primers that bind to sequence encoded by the polynucleotide molecules to amplify from the subset of cells DNA from the locus of a DSB into which sequence encoded by one of the polynucleotide molecules has been inserted; and (d) sequencing the amplified DNA to identify the locus associated with the phenotype of interest.

In embodiments, the cells are plant cells or plant protoplasts or algal cells. In embodiments, the genetically heterogeneous population of cells undergoes one or more doubling cycles; for example, the population of cells is provided with growth conditions that should normally result in cell division, and at least some of the cells undergo one or more doublings. In embodiments, the genetically heterogeneous population of cells is subjected to conditions permitting expression of the phenotype of interest. In embodiments, the cells are provided in a single pool or population (e. g., in a single container); in other embodiments, the cells are provided in an arrayed format (e. g., in microwell plates or in droplets in a microfluidics device or attached individually to particles or beads).

In embodiments, the RNA-guided nuclease or a polynucleotide that encodes the RNA-guided nuclease is exogenously provided to the population of cells. In embodiments, each gRNA is provided as a polynucleotide composition including: (a) a CRISPR RNA (crRNA) that includes the gRNA, or a polynucleotide that encodes a crRNA, or a polynucleotide that is processed into a crRNA; or (b) a single guide RNA (sgRNA) that includes the gRNA, or a polynucleotide that encodes a sgRNA, or a polynucleotide that is processed into a sgRNA In embodiments, the multiple guide RNAs are provided as ribonucleoproteins (e. g., Cas9 nuclease molecules complexed with different gRNAs to form different RNPs). In embodiments, each gRNA is provided as a ribonucleoprotein (RNP) including the RNA-guided nuclease and an sgRNA. In embodiments, multiple guide RNAs are provided, as well as a single polynucleotide donor molecule having a sequence to be integrated at the resulting DSBs; in other embodiments, multiple guide RNAs are provided, as well as different polynucleotide donor molecules having a sequence to be integrated at the resulting multiple DSBs.

In another embodiment, a detection method is provided for identifying a plant as having been subjected to genomic modification according to a targeted modification method described herein, where that modification method yields a low frequency of off-target mutations. The detection method comprises a step of identifying the off-target mutations (e.g., an insertion of a non-specific sequence, a deletion, or an indel resulting from the use of the targeting agents, or insertions of part or all of a sequence encoded by one or more polynucleotide donor molecules at one or more coding or non-coding loci in a genome). In a related embodiment, the detection method is used to track of movement of a plant cell or plant or product thereof through a supply chain. The presence of such an identified mutation in a processed product or commodity product is de facto evidence that the product contains or is derived from a plant cell, plant, or seed of this invention. In related embodiments, the presence of the off-target mutations are identified using PCR, a chip-based assay, probes specific for the donor sequences, or any other technique known in the art to be useful for detecting the presence of particular nucleic acid sequences.

EXAMPLES

Example 1

This example illustrates techniques for preparing a plant cell or plant protoplast useful in compositions and methods of the invention, for example, in providing a reaction mixture including a plant cell having a double-strand break (DSB) at least one locus in its genome. More specifically this non-limiting example describes techniques for preparing isolated, viable plant protoplasts from monocot and dicot plants.

The following mesophyll protoplast preparation protocol (modified from one publicly available at molbio[dot]mgh [dot]harvard.edu/sheenweb/protocols_reg[dot]html) is generally suitable for use with monocot plants such as maize (*Zea mays*) and rice (*Oryza sativa*):

Prepare an enzyme solution containing 0.6 molar mannitol, 10 millimolar MES pH 5.7, 1.5% cellulase R10, and 0.3% macerozyme R10. Heat the enzyme solution at 50-55 degrees Celsius for 10 minutes to inactivate proteases and accelerate enzyme solution and cool it to room temperature before adding 1 millimolar $CaCl_2$, 5 millimolar β-mercaptoethanol, and 0.1% bovine serum albumin. Pass the enzyme solution through a 0.45 micrometer filter. Prepare a washing solution containing 0.6 molar mannitol, 4 millimolar MES pH 5.7, and 20 millimolar KCl.

Obtain second leaves of the monocot plant (e. g., maize or rice) and cut out the middle 6-8 centimeters. Stack ten leaf sections and cut into 0.5 millimeter-wide strips without bruising the leaves. Submerge the leaf strips completely in the enzyme solution in a petri dish, cover with aluminum foil, and apply vacuum for 30 minutes to infiltrate the leaf tissue. Transfer the dish to a platform shaker and incubate for an additional 2.5 hours' digestion with gentle shaking (40 rpm). After digestion, carefully transfer the enzyme solution (now containing protoplasts) using a serological pipette through a 35 micrometer nylon mesh into a round-bottom tube; rinse the petri with 5 milliliters of washing solution and filter this through the mesh as well. Centrifuge the protoplast suspension at 1200 rpm, 2 minutes in a swing-bucket centrifuge. Aspirate off as much of the supernatant as possible without touching the pellet; gently wash the pellet once with 20 milliliters washing buffer and remove the supernatant carefully. Gently resuspend the pellet by swirling in a small volume of washing solution, then resuspend in 10-20 milliliters of washing buffer. Place the tube upright on ice for 30 minutes-4 hours (no longer). After resting on ice, remove the supernatant by aspiration and resuspend the pellet with 2-5 milliliters of washing buffer. Measure the concentration of protoplasts using a hemocytometer and adjust the concentration to $2\times10^5$ protoplasts/milliliter with washing buffer.

The following mesophyll protoplast preparation protocol (modified from one described by Niu and Sheen (2012) *Methods Mol. Biol.*, 876:195-206, doi:10.1007/978-1-61779-809-2_16) is generally suitable for use with dicot plants such as *Arabidopsis thaliana* and brassicas such as kale (*Brassica oleracea*).

Prepare an enzyme solution containing 0.4 M mannitol, 20 millimolar KCl, 20 millimolar MES pH 5.7, 1.5% cellulase R10, and 0.4% macerozyme R10. Heat the enzyme solution at 50-55 degrees Celsius for 10 minutes to inactivate proteases and accelerate enzyme solution, and then cool it to room temperature before adding 10 millimolar $CaCl_2$, 5 millimolar β-mercaptoethanol, and 0.1% bovine serum albumin. Pass the enzyme solution through a 0.45 micrometer filter. Prepare a "W5" solution containing 154 millimolar NaCl, 125 millimolar $CaCl_2$, 5 millimolar KCl, and 2 millimolar MES pH 5.7. Prepare a "MMg solution" solution containing 0.4 molar mannitol, 15 millimolar $MgCl_2$, and 4 millimolar MES pH 5.7.

Obtain second or third pair true leaves of the dicot plant (e. g., a *Brassica* such as kale) and cut out the middle section. Stack 4-8 leaf sections and cut into 0.5 millimeter-wide strips without bruising the leaves. Submerge the leaf strips completely in the enzyme solution in a petri dish, cover with aluminum foil, and apply vacuum for 30 minutes to infiltrate the leaf tissue. Transfer the dish to a platform shaker and incubate for an additional 2.5 hours' digestion with gentle shaking (40 rpm). After digestion, carefully transfer the enzyme solution (now containing protoplasts) using a serological pipette through a 35 micrometer nylon mesh into a round-bottom tube; rinse the petri dish with 5 milliliters of washing solution and filter this through the mesh as well. Centrifuge the protoplast suspension at 1200 rpm, 2 minutes in a swing-bucket centrifuge. Aspirate off as much of the supernatant as possible without touching the pellet; gently wash the pellet once with 20 milliliters washing buffer and remove the supernatant carefully. Gently resuspend the pellet by swirling in a small volume of washing solution, then resuspend in 10-20 milliliters of washing buffer. Place the tube upright on ice for 30 minutes-4 hours (no longer). After resting on ice, remove the supernatant by aspiration and resuspend the pellet with 2-5 milliliters of MMg solution. Measure the concentration of protoplasts using a hemocytometer and adjust the concentration to $2\times10^5$ protoplasts/milliliter with MMg solution.

Example 2

This example illustrates culture conditions effective in improving viability of plant cells or plant protoplasts. More specifically, this non-limiting example describes media and culture conditions for improving viability of isolated plant protoplasts.

Table 1 provides the compositions of different liquid basal media suitable for culturing plant cells or plant protoplasts; final pH of all media was adjusted to 5.8 if necessary.

TABLE 1

| Component | Concentration (mg/L unless otherwise noted) | | | | |
|---|---|---|---|---|---|
| | SH | 8p | PIM | P2 | YPIMB- |
| Casamino acids | | 250 | | | |
| Coconut water | | 20000 | | | |
| Ascorbic acid | | 2 | | | |
| biotin | | 0.01 | 0.01 | | |
| Cholicalciferol (Vitamin D-3) | | 0.01 | | | |
| choline chloride | | 1 | | | |
| Citric acid | | 40 | | | |
| Cyanocobalamin (Vitamin B-12) | | 0.02 | | | |
| D-calcium pantothenate | | 1 | 1 | | |
| D-Cellobiose | | 250 | | | |
| D-Fructose | | 250 | | | |
| D-Mannose | | 250 | | | |
| D-Ribose | | 250 | | | |
| D-Sorbitol | | 250 | | | |
| D-Xylose | | 250 | | | |
| folic acid | | 0.4 | 0.2 | | |
| Fumaric acid | | 40 | | | |
| L-Malic acid | | 40 | | | |
| L-Rhamnose | | 250 | | | |
| p-Aminobenzoic acid | | 0.02 | | | |
| Retinol (Vitamin A) | | 0.01 | | | |
| Riboflavin | | 0.2 | | | |
| Sodium pyruvate | | 20 | | | |
| 2,4-D | 0.5 | 0.2 | 1 | 5 | 1 |
| 6-benzylaminopurine (BAP) | | | | | 1 |
| Indole-3-butyric acid (IBA) | | | | 2.5 | |
| Kinetin | 0.1 | | | | |
| Naphthaleneacetic acid (NAA) | | 1 | | | |
| parachlorophenoxyacetate (pCPA) | 2 | | | | |
| Thidiazuron | | | 0.022 | | |
| Zeatin | | 0.5 | | | |
| AlCl3 | | | 0.03 | | |
| Bromocresol purple | | | 8 | | |
| CaCl$_2$•2H$_2$O | 200 | 600 | 440 | 200 | 440 |
| CoCl$_2$•6H$_2$O | 0.1 | 0.025 | | 0.1 | |
| CuSO$_4$•5H$_2$O | 0.2 | 0.025 | 0.03 | 0.2 | 0.03 |
| D-Glucose | | 68400 | 40000 | | 40000 |
| D-Mannitol | 52000 | 250 | 60000 | 52000 | 60000 |
| FeSO$_4$•7H$_2$O | 15 | 27.8 | 15 | 15 | 15 |
| H$_3$BO$_3$ | 5 | 3 | 1 | 5 | 1 |
| KCl | | 300 | | | |
| KH$_2$PO$_4$ | | 170 | 170 | | 170 |
| KI | 1 | 0.75 | 0.01 | 1 | 0.01 |
| KNO$_3$ | 2500 | 1900 | 505 | 2500 | 505 |
| MES pH 5.8 (mM) | | | 3.586 | 25 | 25 |
| MgSO$_4$•7H$_2$O | 400 | 300 | 370 | 400 | 370 |
| MnSO$_4$•H$_2$O | 10 | 10 | 0.1 | 10 | 0.1 |
| Na$_2$EDTA | 20 | 37.3 | 20 | 20 | 20 |
| Na$_2$MoO$_4$•2H$_2$O | 0.1 | 0.25 | | 0.1 | |
| NH$_4$H$_2$PO$_4$ | | 300 | | 300 | |
| NH$_4$NO$_3$ | | 600 | 160 | | 160 |
| NiCl$_2$•6H$_2$O | | | 0.03 | | |
| Sucrose | 30000 | 2500 | | 30000 | |
| ZnSO$_4$•7H$_2$O | 1 | 2 | 1 | 1 | 1 |
| Tween-80 (microliter/L) | | | 10 | | 10 |
| Inositol | 1000 | 100 | 100 | 1000 | 100 |
| Nicotinamide | | 1 | | | |
| Nicotinic acid | 5 | | 1 | 5 | 1 |
| Pyridoxine•HCl | 0.5 | 1 | 1 | 0.5 | 1 |
| Thiamine•HCl | 5 | 1 | 1 | 5 | 1 |

\* Sources for basal media:
SH - Schenk and Hildebrandt, *Can. J. Bot.* 50:199 (1971).
8p - Kao and Michayluk, *Planta* 126:105 (1975).
P2 - SH but with hormones from Potrykus et al., *Mol. Gen. Genet.* 156:347 (1977).
PIM - Chupeau et al., The Plant Cell 25:2444 (2013).

Example 3

This example illustrates culture conditions effective in improving viability of plant cells or plant protoplasts. More specifically, this non-limiting example describes methods for encapsulating isolated plant protoplasts.

When protoplasts are encapsulated in alginate or pectin, they remain intact far longer than they would in an equivalent liquid medium. In order to encapsulate protoplasts, a liquid medium ("calcium base") is prepared that is in all other respects identical to the final desired recipe with the exception that the calcium (usually CaCl$_2$)·2H2O) is increased to 80 millimolar. A second medium ("encapsulation base") is prepared that has no added calcium but contains 10 g/L of the encapsulation agent, e. g., by making a 20 g/L solution of the encapsulation agent and adjusting its pH with KOH or NaOH until it is about 5.8, making a 2× solution of the final medium (with no calcium), then combining these two solutions in a 1:1 ratio. Encapsulation agents include alginate (e. g., alginic acid from brown algae, catalogue number A0682, Sigma-Aldrich, St. Louis, MO) and pectin (e. g., pectin from citrus peel, catalogue number P9136, Sigma-Aldrich, St. Louis, MO; various pectins including non-amidated low-methoxyl pectin, catalogue number 1120-50 from Modernist Pantry, Portsmouth, NH).

The solutions, including the encapsulation base solution, is filter-sterilized through a series of filters, with the final filter being a 0.2-micrometer filter. Protoplasts are pelleted by gentle centrifugation and resuspended in the encapsulation base; the resulting suspension is added dropwise to the calcium base, upon which the protoplasts are immediately encapsulated in solid beads.

Example 4

This example illustrates culture conditions effective in improving viability of plant cells or plant protoplasts. More specifically, this non-limiting example describes observations of effects on protoplast viability obtained by adding non-conventionally high levels of divalent cations to culture media.

Typical plant cell or plant protoplast media contain between about 2 to about 4 millimolar calcium cations and between about 1-1.5 millimolar magnesium cations. In the course of experiments varying and adding components to media, it was discovered that the addition of non-conventionally high levels of divalent cations had a surprisingly beneficial effect on plant cell or plant protoplast viability. Beneficial effects on plant protoplast viability begin to be seen when the culture medium contains about 30 millimolar calcium cations (e. g., as calcium chloride) or about 30 millimolar magnesium cations (e. g., as magnesium chloride). Even higher levels of plant protoplast viability were observed with increasing concentrations of calcium or magnesium cations, i. e., at about 40 millimolar or about 50 millimolar calcium or magnesium cations. The result of several titration experiments indicated that greatest improvement in protoplast viability was seen using media containing between about 50 to about 100 millimolar calcium cations or 50 to about 100 millimolar magnesium cations; no negative effects on protoplast viability or physical appearance was observed at these high cation levels. This was observed in multiple experiments using protoplasts obtained from several plant species including maize (multiple germplasms, e. g., B73, A188, B104, HiIIA, HiIIB, BMS), rice, wheat, soy, kale, and strawberry; improved protoplast viability was observed in both encapsulated protoplasts and non-encapsulated protoplasts. Addition of potassium chloride at the same levels had no effect on protoplast viability. It is possible that inclusion of slightly lower (but still non-conventionally high) levels of divalent cations (e. g., about 10 millimolar, about 15 millimolar, about 20 millimolar, or about 25 millimolar calcium cations or magnesium cations) in media is beneficial for plant cells or plant protoplasts of additional plant species.

Example 5

This example illustrates culture conditions effective in improving viability of plant cells or plant protoplasts. More specifically, this non-limiting example describes observations of effects on maize, soybean, and strawberry protoplast viability obtained by adding non-conventionally high levels of divalent cations to culture media.

Separate suspensions of maize B73, winter wheat, soy, and strawberry protoplasts ($2\times10^5$ cells per milliliter) were prepared in YPIM B-liquid medium containing calcium chloride at 0, 50, or 100 millimolar. One-half milliliter aliquots of the suspensions were dispensed into a 24-well microtiter plate.

Viability at day 8 of culture was judged by visualization under a light microscope. At this point, the viability of the maize protoplasts in the 0, 50, and 100 millimolar calcium conditions was 10%, 30%, and 80%, respectively. There were no large differences observed at this time point for protoplasts of the other species.

Viability at day 13 was judged by Evans blue staining and visualization under a light microscope. At this point, the viability of the maize protoplasts in the 0, 50, and 100 millimolar calcium conditions was 0%, 0%, and 10%, respectively; viability of the soybean protoplasts in the 0, 50, and 100 millimolar calcium conditions was 0%, 50%, and 50%, respectively; and viability of the maize protoplasts in the 0 and 50 millimolar calcium conditions was 0% and 50%, respectively (viability was not measured for the 100 millimolar condition). These results demonstrate that culture conditions including calcium cations at 50 or 100 millimolar improved viability of both monocot and dicot protoplasts over a culture time of ~13 days.

Example 6

This example illustrates a method of delivery of an effector molecule to a plant cell or plant protoplast to effect a genetic change, in this case introduction of a double-strand break in the genome. More specifically, this non-limiting example describes a method of delivering a guide RNA (gRNA) in the form of a ribonucleoprotein (RNP) to isolated plant protoplasts.

The following delivery protocol (modified from one publicly available at molbio[dot]mgh[dot]harvard.edu/sheenweb/protocols_reg[dot]html) is generally suitable for use with monocot plants such as maize (Zea mays) and rice (Oryza sativa):

Prepare a polyethylene glycol (PEG) solution containing 40% PEG 4000, 0.2 molar mannitol, and 0.1 molar $CaCl_2$. Prepare an incubation solution containing 170 milligram/liter $KH_2PO_4$, 440 milligram/liter $CaCl_2 \cdot 2H_2O$, 505 milligram/liter $KNO_3$, 160 milligram/liter $NH_4NO_3$, 370 milligram/liter $MgSO_4 \cdot 7H_2O$, 0.01 milligram/liter KI, 1 milligram/liter $H_3BO_3$, 0.1 milligram/liter $MnSO_4 \cdot 4H_2O$, 1 milligram/liter $ZnSO_4 \cdot 7H_2O$, 0.03 milligram/liter $CuSO_4 \cdot 5H_2O$, 1 milligram/liter nicotinic acid, 1 milligram/liter thiamine HCl, 1 milligram/liter pyridoxine HCl, 0.2 milligram/liter folic acid, 0.01 milligram/liter biotin, 1 milligram/liter D-Ca-pantothenate, 100 milligram/liter myo-inositol, 40 grams/liter glucose, 60 grams/liter mannitol, 700 milligram/liter MES, 10 microliter/liter Tween 80, 1 milligram/liter 2,4-D, and 1 milligram/liter 6-benzylaminopurine (BAP); adjust pH to 5.6.

Prepare a crRNA:tracrRNA or guide RNA (gRNA) complex by mixing equal amounts of CRISPR crRNA and tracrRNA (obtainable e. g., as custom-synthesized Alt-R™ CRISPR crRNA and tracrRNA oligonucleotides from Integrated DNA Technologies, Coralville, IA): mix 6 microliters of 100 micromolar crRNA and 6 microliters of 100 micromolar tracrRNA, heat at 95 degrees Celsius for 5 minutes, and then cool the crRNA:tracrRNA complex to room temperature. To the cooled gRNA solution, add 10 micrograms Cas9 nuclease (Aldevron, Fargo, ND) and incubate 5 minutes at room temperature to allow the ribonucleoprotein (RNP) complex to form. Add the RNP solution to 100 microliters of monocot protoplasts (prepared as described in Example 1) in a microfuge tube; add 5 micrograms salmon sperm DNA (VWR Cat. No.: 95037-160) and an equal volume of the PEG solution. Mix gently by tapping. After 5 minutes, dilute with 880 microliters of washing buffer and mix gently by inverting the tube. Centrifuge 1 minute at 1200 rpm and then remove the supernatant. Resuspend the protoplasts in 1 milliliter incubation solution and transfer to a multi-well plate. The efficiency of genome editing is assessed by any suitable method such as heteroduplex cleavage assay or by sequencing, as described elsewhere in this disclosure.

The following delivery protocol (modified from one described by Niu and Sheen (2012) *Methods Mol. Biol.*, 876:195-206, doi:10.1007/978-1-61779-809-2_16) is generally suitable for use with dicot plants such as *Arabidopsis thaliana* and brassicas such as kale (*Brassica oleracea*):

Prepare a polyethylene glycol (PEG) solution containing 40% PEG 4000, 0.2 molar mannitol, and 0.1 molar $CaCl_2$. Prepare an incubation solution containing 170 milligram/liter $KH_2PO_4$, 440 milligram/liter $CaCl_2 \cdot 2H_2O$, 505 milligram/liter $KNO_3$, 160 milligram/liter $NH_4NO_3$, 370 milligram/liter $MgSO_4 \cdot 7H_2O$, 0.01 milligram/liter KI, 1 milligram/liter $H_3BO_3$, 0.1 milligram/liter $MnSO_4 \cdot 4H_2O$, 1 milligram/liter $ZnSO_4 \cdot \gamma H_2O$, 0.03 milligram/liter $CuSO_4 \cdot 5H_2O$, 1 milligram/liter nicotinic acid, 1 milligram/liter thiamine HCl, 1 milligram/liter pyridoxine HCl, 0.2 milligram/liter folic acid, 0.01 milligram/liter biotin, 1 milligram/liter D-Ca-pantothenate, 100 milligram/liter myo-inositol, 40 grams/liter glucose, 60 grams/liter mannitol, 700 milligram/liter MES, 10 microliter/liter Tween 80, 1 milligram/liter 2,4-D, and 1 milligram/liter 6-benzylaminopurine (BAP); adjust pH to 5.6.

Prepare a crRNA:tracrRNA or guide RNA (gRNA) complex by mixing equal amounts of CRISPR crRNA and tracrRNA (obtainable e. g., as custom-synthesized Alt-R™ CRISPR crRNA and tracrRNA oligonucleotides from Integrated DNA Technologies, Coralville, IA): mix 6 microliters of 100 micromolar crRNA and 6 microliters of 100 micromolar tracrRNA, heat at 95 degrees Celsius for 5 minutes, and then cool the crRNA:tracrRNA complex to room temperature. To the cooled gRNA solution, add 10 micrograms Cas9 nuclease (Aldevron, Fargo, ND) and incubate 5 minutes at room temperature to allow the ribonucleoprotein (RNP) complex to form. Add the RNP solution to 100 microliters of dicot protoplasts (prepared as described in Example 1) in a microfuge tube; add 5 micrograms salmon sperm DNA (VWR Cat. No.: 95037-160) and an equal volume of the PEG solution. Mix gently by tapping. After 5 minutes, dilute with 880 microliters of washing buffer and mix gently by inverting the tube. Centrifuge 1 minute at 1200 rpm and then remove the supernatant. Resuspend the protoplasts in 1 milliliter incubation solution and transfer to a multi-well plate. The efficiency of genome editing is assessed by any suitable method such as heteroduplex cleavage assay or by sequencing, as described elsewhere in this disclosure.

The above protocols for delivery of gRNAs as RNPs to plant protoplasts are adapted for delivery of guide RNAs alone to monocot or dicot protoplasts that express Cas9 nuclease by transient or stable transformation; in this case, the guide RNA complex is prepared as before and added to the protoplasts, but no Cas9 nuclease and no salmon sperm DNA is added. The remainder of the procedures are identical.

Example 7

This example illustrates genome editing in plants and further illustrates a method of delivering gene-editing effector molecules into a plant cell. This example describes introducing at least one double-strand break (DSB) in a genome in a plant cell or plant protoplast, by delivering at least one effector molecules to the plant cell or plant protoplast using at least one physical agent, such as a particulate, microparticulate, or nanoparticulate. More specifically, this non-limiting example illustrates introducing at least one double-strand break (DSB) in a genome in a plant cell or plant protoplast by contacting the plant cell or plant protoplast with a composition including at least one sequence-specific nuclease and at least one physical agent, such as at least one nanocarrier. Embodiments include those wherein the nanocarrier comprises metals (e. g., gold, silver, tungsten, iron, cerium), ceramics (e. g., aluminum oxide, silicon carbide, silicon nitride, tungsten carbide), polymers (e. g., polystyrene, polydiacetylene, and poly(3,4-ethylenedioxythiophene) hydrate), semiconductors (e. g., quantum dots), silicon (e. g., silicon carbide), carbon (e. g., graphite, graphene, graphene oxide, or carbon nanosheets, nanocomplexes, or nanotubes), composites (e. g., polyvinylcarbazole/graphene, polystyrene/graphene, platinum/graphene, palladium/graphene nanocomposites), a polynucleotide, a poly (AT), a polysaccharide (e. g., dextran, chitosan, pectin, hyaluronic acid, and hydroxyethylcellulose), a polypeptide, or a combination of these. In embodiments, such particulates and nanoparticulates are further covalently or non-covalently functionalized, or further include modifiers or cross-linked materials such as polymers (e. g., linear or branched polyethylenimine, poly-lysine), polynucleotides (e. g., DNA or RNA), polysaccharides, lipids, polyglycols (e. g., polyethylene glycol, thiolated polyethylene glycol), polypeptides or proteins, and detectable labels (e. g., a fluorophore, an antigen, an antibody, or a quantum dot). Embodiments include those wherein the nanocarrier is a nanotube, a carbon nanotube, a multi-walled carbon nanotube, or a single-walled carbon nanotube. Specific nanocarrier embodiments contemplated herein include the single-walled carbon nanotubes, cerium oxide nanoparticles ("nanoceria"), and modifications thereof (e. g., with cationic, anionic, or lipid coatings) described in Giraldo et al. (2014) *Nature Materials*, 13:400-409; the single-walled carbon nanotubes and heteropolymer complexes thereof described in Zhang et al. (2013) *Nature Nanotechnol.*, 8:959-968 (doi: 10.1038/NNANO.2013.236); the single-walled carbon nanotubes and heteropolymer complexes thereof described in Wong et al. (2016) *Nano Lett.*, 16:1161-1172; and the various carbon nanotube preparations described in US Patent Application Publication US 2015/0047074 and International Patent Application PCT/US2015/050885 (published as WO 2016/044698 and claiming priority to U.S. Provisional Patent Application 62/052,767), all of which patent applications are incorporated in their entirety by reference herein. See also, for example, the various types of particles and nanoparticles, their preparation, and methods for their use, e. g., in delivering polynucleotides and polypeptides to cells, disclosed in US Patent Application Publications 2010/0311168, 2012/0023619, 2012/0244569, 2013/0145488, 2013/0185823, 2014/0096284, 2015/0040268, 2015/0047074, and 2015/0208663, all of which are incorporated herein by reference in their entirety.

In these examples, single-walled carbon nanotubes (SWCNT) and modifications thereof are prepared as described in Giraldo et al. (2014) *Nature Materials*, 13:400-409; Zhang et al. (2013) *Nature Nanotechnol.*, 8:959-968; Wong et al. (2016) *Nano Lett.*, 16:1161-1172; US Patent Application Publication US 2015/0047074; and International Patent Application PCT/US2015/050885 (published as WO 2016/044698). In an initial experiment, a DNA plasmid encoding green fluorescent protein (GFP) as a reporter is non-covalently complexed with a SWCNT preparation and tested on various plant cell preparations including plant cells in suspension culture, plant callus, plant embryos, intact or half seeds, and shoot apical meristem. Delivery to the plant callus, embryos, seeds, and meristem is by treatment with pressure, centrifugation, bombardment, microinjection, infiltration (e. g., with a syringe), or by direct application to the surface of the plant tissue. Efficiency of the SWCNT delivery of GFP across the plant cell wall and the cellular localization of the GFP signal is evaluated by microscopy.

In another experiment, plasmids encoding Cas9 and at least one guide RNA (gRNA), such as those described in Example 6, are non-covalently complexed with a SWCNT preparation and tested on various plant cell preparations including plant cells in suspension culture, plant callus, plant embryos, intact or half seeds, and shoot apical meristem. Delivery to the plant callus, embryos, seeds, and meristem is by treatment with pressure, centrifugation, bombardment, microinjection, infiltration (e. g., with a syringe), or by direct application to the surface of the plant tissue. The gRNA is designed to target the endogenous plant gene phytoene desaturase (PDS) for silencing, where PDS silencing produces a visible phenotype (bleaching, or low/no chlorophyll).

In another experiment, RNA encoding Cas9 and at least one guide RNA (gRNA), such as those described in Example 6, are non-covalently complexed with a SWCNT preparation and tested on various plant cell preparations including plant cells in suspension culture, plant callus, plant embryos, intact or half seeds, and shoot apical meristem. Delivery to the plant callus, embryos, seeds, and meristem is by treatment with pressure, centrifugation, bombardment, microinjection, infiltration (e. g., with a syringe), or by direct application to the surface of the plant tissue. The gRNA is designed to target the endogenous plant gene phytoene desaturase (PDS) for silencing, where PDS silencing produces a visible phenotype (bleaching, or low/no chlorophyll).

In another experiment, a ribonucleoprotein (RNP), prepared by complexation of Cas9 nuclease and at least one guide RNA (gRNA), is non-covalently complexed with a SWCNT preparation and tested on various plant cell preparations including plant cells in suspension culture, plant callus, plant embryos, intact or half seeds, and shoot apical meristem. Delivery to the plant callus, embryos, seeds, and meristem is by treatment with pressure, centrifugation, bombardment, microinjection, infiltration (e. g., with a syringe), or by direct application to the surface of the plant tissue. The gRNA is designed to target the endogenous plant gene phytoene desaturase (PDS) for silencing, where PDS silencing produces a visible phenotype (bleaching, or low/no chlorophyll).

One of skill in the art would recognize that the above general compositions and procedures can be modified or combined with other reagents and treatments, such as those described in detail in the paragraphs following the heading "Delivery Methods and Delivery Agents". In addition, the single-walled carbon nanotubes (SWCNT) and modifications thereof prepared as described in Giraldo et al. (2014) *Nature Materials*, 13:400-409; Zhang et al. (2013) *Nature Nanotechnol.*, 8:959-968; Wong et al. (2016) *Nano Lett.*, 16:1161-1172; US Patent Application Publication US 2015/0047074; and International Patent Application PCT/US2015/050885 (published as WO 2016/044698) can be used to prepare complexes with other polypeptides or polynucleotides or a combination of polypeptides and polynucleotides (e. g., with one or more polypeptides or ribonucleoproteins including at least one functional domain selected from the group consisting of: transposase domains, integrase domains, recombinase domains, resolvase domains, invertase domains, protease domains, DNA methyltransferase domains, DNA hydroxylmethylase domains, DNA demethylase domains, histone acetylase domains, histone deacetylase domains, nuclease domains, repressor domains, activator domains, nuclear-localization signal domains, transcription-regulatory protein (or transcription complex recruiting) domains, cellular uptake activity associated domains, nucleic acid binding domains, antibody presentation domains, histone modifying enzymes, recruiter of histone modifying enzymes, inhibitor of histone modifying enzymes, histone methyltransferases, histone demethylases, histone kinases, histone phosphatases, histone ribosylases, histone deribosylases, histone ubiquitinases, histone deubiquitinases, histone biotinases, and histone tail proteases).

Example 8

This example illustrates genome editing in plants and further illustrates a method of delivering gene-editing effector molecules into a plant cell. More specifically, this non-limiting example describes introducing at least one double-strand break (DSB) in a genome in a plant cell or plant protoplast, by contacting the plant cell or plant protoplast with a composition including a sequence-specific nuclease complexed with a gold nanoparticle.

In embodiments, at least one double-strand break (DSB) is introduced in a genome in a plant cell or plant protoplast, by contacting the plant cell or plant protoplast with a composition that includes a charge-modified sequence-specific nuclease complexed to a charge-modified gold nanoparticle, wherein the complexation is non-covalent, e. g., through ionic or electrostatic interactions. In an embodiment, a sequence-specific nuclease having at least one region bearing a positive charge forms a complex with a negatively-charged gold particle; in another embodiment, a sequence-specific nuclease having at least one region bearing a negative charge forms a complex with a positively-charged gold particle. Any suitable method can be used for modifying the charge of the nuclease or the nanoparticle, for instance, through covalent modification to add functional groups, or non-covalent modification (e. g., by coating a nanoparticle with a cationic, anionic, or lipid coating). In embodiments, the sequence-specific nuclease is a type II Cas nuclease having at least one modification selected from the group consisting of: (a) modification at the N-terminus with at least one negatively charged moiety; (b) modification at the N-terminus with at least one moiety carrying a carboxylate functional group; (c) modification at the N-terminus with at least one glutamate residue, at least one aspartate residue, or a combination of glutamate and aspartate residues; (d) modification at the C-terminus with a localization signal, transit, or targeting peptide; (e) modification at the C-terminus with a nuclear localization signal (NLS), a chloroplast transit peptide (CTP), or a mitochondrial targeting peptide (MTP). In embodiments, the type II Cas nuclease is a Cas9 from *Streptococcus pyogenes* wherein the Cas9 is modified at the N-terminus with at least one negatively charged moiety and modified at the C-terminus with a nuclear localization signal (NLS), a chloroplast transit peptide (CTP), or a mitochondrial targeting peptide (MTP). In embodiments, the type II Cas nuclease is a Cas9 from *Streptococcus pyogenes* wherein the Cas9 is modified at the N-terminus with a polyglutamate peptide and modified at the C-terminus with a nuclear localization signal (NLS). In embodiments, the gold nanoparticle has at least one modification selected from the group consisting of: (a) modification with positively charged moieties; (b) modification with at least one moiety carrying a positively charged amine; (c) modification with at least one polyamine; (d) modification with at least one lysine residue, at least one histidine residue, at least one arginine residue, at least one guanidine, or a combination thereof. Specific embodiments include those wherein: (a) the sequence-specific nuclease is a type II Cas nuclease modified at the N-terminus with at least one negatively charged moiety and modified at the C-terminus with a nuclear localization signal (NLS), a chloroplast transit peptide (CTP), or a mitochondrial targeting peptide (MTP); and the gold nanoparticle is modified with at least one positively charged moiety; (b) the type II Cas nuclease is a Cas9 from *Streptococcus pyogenes* modified at the N-terminus with a polyglutamate peptide and modified at the C-terminus with a nuclear localization signal (NLS); and the gold nanoparticle is modified with at least one at least one lysine residue, at least one histidine residue, at least one arginine residue, at least one guanidine, or a combination thereof; (c) the type II Cas nuclease is a Cas9 from *Streptococcus pyogenes* modified at the N-terminus with a polyglutamate peptide that includes at least 15 glutamate residues and modified at the C-terminus with a nuclear localization signal (NLS); and wherein the gold nanoparticle is modified with at least one at least one lysine residue, at least one histidine residue, at least one arginine residue, at least one guanidine, or a combination thereof. In a specific embodiment, at least one double-strand break (DSB) is introduced in a genome in a plant cell or plant protoplast, by contacting the plant cell or plant protoplast with a composition including a sequence-specific nuclease complexed with a gold nanoparticle, wherein the sequence-specific nuclease is a Cas9 from *Streptococcus pyogenes* modified at the N-terminus with a polyglutamate peptide that includes at least 15 glutamate residues and modified at the C-terminus with a nuclear localization signal (NLS); and wherein the gold nanoparticle is in the form of cationic arginine gold nanoparticles (ArgNPs), and wherein when the modified Cas9 and the ArgNPs are mixed, self-assembled nanoassemblies are formed as described in Mout et al. (2017) *ACS Nano*, doi:10.1021/acsnano.6b07600. Other embodiments contemplated herein include the various nanoparticle-protein complexes (e. g., amine-bearing nanoparticles complexed with carboxylate-bearing proteins) described in International Patent Application PCT/US2016/015711, published as International Patent Application Publication WO2016/123514, which claims priority to U.S. Provisional Patent Applications 62/109,389, 62/132,798, and 62/169,805, all of which patent applications are incorporated in their entirety by reference herein.

In embodiments, the sequence-specific nuclease is an RNA-guided DNA endonuclease, such as a type II Cas nuclease, and the composition further includes at least one guide RNA (gRNA) for an RNA-guided nuclease, or a DNA encoding a gRNA for an RNA-guided nuclease. The method effects the introduction of at least one double-strand break (DSB) in a genome in a plant cell or plant protoplast; in embodiments, the genome is that of the plant cell or plant protoplast; in embodiments, the genome is that of a nucleus, mitochondrion, plastid, or endosymbiont in the plant cell or plant protoplast. In embodiments, the at least one double-strand break (DSB) is introduced into coding sequence, non-coding sequence, or a combination of coding and non-coding sequence. In embodiments, the plant cell or plant protoplast is a plant cell in an intact plant or seedling or plantlet, a plant tissue, seed, embryo, meristem, germline cells, callus, or a suspension of plant cells or plant protoplasts.

In embodiments, at least one dsDNA molecule is also provided to the plant cell or plant protoplast, and is integrated at the site of at least one DSB or at the location where genomic sequence is deleted between two DSBs. Embodiments include those wherein: (a) the at least one DSB is two blunt-ended DSBs, resulting in deletion of genomic sequence between the two blunt-ended DSBs, and wherein the dsDNA molecule is blunt-ended and is integrated into the genome between the two blunt-ended DSBs; (b) the at least one DSB is two DSBs, wherein the first DSB is blunt-ended and the second DSB has an overhang, resulting in deletion of genomic sequence between the two DSBs, and wherein the dsDNA molecule is blunt-ended at one terminus and has an overhang on the other terminus, and is integrated into the genome between the two DSBs; (c) the at least one DSB is two DSBs, each having an overhang, resulting in deletion of genomic sequence between the two DSBs, and wherein the dsDNA molecule has an overhang at each terminus and is integrated into the genome between the two DSBs.

In a non-limiting example, self-assembled green fluorescent protein (GFP)/cationic arginine gold nanoparticles (ArgNPs), nanoassemblies are prepared as described in International Patent Application Publication WO2016/123514. The GFP/ArgNP nanoassemblies are delivered to maize protoplasts and to kale protoplasts prepared as described in Example 1, and to protoplasts prepared from the Black Mexican Sweet (BMS) maize cell line. Efficiency of transfection or delivery is assessed by fluorescence microscopy at time points after transfection (30 minutes, 1 hour, 3 hours, 6 hours, and overnight).

In a non-limiting example, self-assembled GFP/cationic arginine gold nanoparticles (ArgNPs), nanoassemblies are prepared as described in International Patent Application Publication WO2016/123514. The GFP/ArgNP nanoassemblies are co-incubated with plant cells in suspension culture. Efficiency of transfection or delivery across the plant cell wall is assessed by fluorescence microscopy at time points after transfection (30 minutes, 1 hour, 3 hours, 6 hours, and overnight).

In a non-limiting example, self-assembled GFP/cationic arginine gold nanoparticles (ArgNPs), nanoassemblies are prepared as described in International Patent Application Publication WO2016/123514. The GFP/ArgNP nanoassemblies are further prepared for Biolistics or particle bombardment and thus delivered to plant cells from suspension cultures transferred to semi-solid or solid media, as well as to tomato embryogenic callus. Efficiency of transfection or delivery across the plant cell wall is assessed by fluorescence microscopy at time points after transfection (30 minutes, 1 hour, 3 hours, 6 hours, and overnight).

In a non-limiting example, self-assembled GFP/cationic arginine gold nanoparticles (ArgNPs), nanoassemblies are prepared as described in International Patent Application Publication WO2016/123514. The GFP/ArgNP nanoassemblies are delivered by infiltration (e. g., using mild positive pressure or negative pressure) into leaves of *Arabidopsis thaliana* plants. Efficiency of transfection or delivery across the plant cell wall is assessed by fluorescence microscopy at time points after transfection (30 minutes, 1 hour, 3 hours, 6 hours, and overnight).

In a non-limiting example, self-assembled Cas9/ArgNP nanoassemblies are prepared as described in Mout et al. (2017) *ACS Nano*, doi:10.1021/acsnano.6b07600 or alternatively as described in International Patent Application Publication WO2016/123514, by mixing a Cas9 from *Streptococcus pyogenes* modified at the N-terminus with a polyglutamate peptide that includes at least 15 glutamate residues and modified at the C-terminus with a nuclear localization signal (NLS) with cationic arginine gold nanoparticles (ArgNPs). The Cas9/ArgNP nanoassemblies are delivered to maize protoplasts or to kale protoplasts prepared as described in Example 1, and to protoplasts prepared from the Black Mexican Sweet (BMS) maize cell line. In one variation of the procedure, the Cas9/ArgNP nanoassemblies are co-delivered with at least one guide RNA (such as those described in Examples, 4, 5, 8, 9, 10, 12, and 13) to the protoplasts. In other variations of the procedure, the self-assembled Cas9/ArgNP nanoassemblies are prepared with at least one guide RNA to allow the modified Cas9 to form a ribonucleoprotein (RNP) either prior to or after formation of the nanoassemblies; the self-assembled RNP/ArgNP nanoassemblies are then delivered to the protoplasts. Efficiency of editing is assessed by any suitable method such as a heteroduplex cleavage assay or by sequencing, as described elsewhere in this disclosure.

In a non-limiting example, self-assembled Cas9/ArgNP nanoassemblies are prepared as described in Mout et al. (2017) *ACS Nano*, doi:10.1021/acsnano.6b07600 or alternatively as described in International Patent Application Publication WO2016/123514, by mixing a Cas9 from *Streptococcus pyogenes* modified at the N-terminus with a polyglutamate peptide that includes at least 15 glutamate residues and modified at the C-terminus with a nuclear localization signal (NLS) with cationic arginine gold nanoparticles (ArgNPs). The Cas9/ArgNP nanoassemblies are co-incubated with plant cells in suspension culture. In one variation of the procedure, the Cas9/ArgNP nanoassemblies are co-delivered with at least one guide RNA (such as those described in Examples, 4, 5, 8, 9, 10, 12, and 13) to the plant cells in suspension culture. In other variations of the procedure, the self-assembled Cas9/ArgNP nanoassemblies are prepared with at least one guide RNA to allow the modified Cas9 to form a ribonucleoprotein (RNP) either prior to or after formation of the nanoassemblies; the self-assembled RNP/ArgNP nanoassemblies are then delivered to the plant cells in suspension culture. Efficiency of editing is assessed by any suitable method such as a heteroduplex cleavage assay or by sequencing, as described elsewhere in this disclosure.

In a non-limiting example, self-assembled Cas9/ArgNP nanoassemblies are prepared as described in Mout et al. (2017) *ACS Nano*, doi:10.1021/acsnano.6b07600 or alternatively as described in International Patent Application Publication WO2016/123514, by mixing a Cas9 from *Streptococcus pyogenes* modified at the N-terminus with a polyglutamate peptide that includes at least 15 glutamate residues and modified at the C-terminus with a nuclear localization signal (NLS) with cationic arginine gold nanoparticles (ArgNPs). The Cas9/ArgNP nanoassemblies are further prepared for Biolistics or particle bombardment and thus delivered to plant cells from suspension cultures transferred to semi-solid or solid media, as well as to tomato embryogenic callus. In one variation of the procedure, the Cas9/ArgNP nanoassemblies are co-delivered with at least one guide RNA (such as those described in Examples, 4, 5, 8, 9, 10, 12, and 13) to the plant cells or callus. In other variations of the procedure, the self-assembled Cas9/ArgNP nanoassemblies are prepared with at least one guide RNA to allow the modified Cas9 to form a ribonucleoprotein (RNP) either prior to or after formation of the nanoassemblies; the self-assembled RNP/ArgNP nanoassemblies are then delivered to the plant cells or callus. Efficiency of editing is assessed by any suitable method such as a heteroduplex cleavage assay or by sequencing, as described elsewhere in this disclosure.

In a non-limiting example, self-assembled Cas9/ArgNP nanoassemblies are prepared as described in Mout et al. (2017) *ACS Nano*, doi:10.1021/acsnano.6b07600 or alternatively as described in International Patent Application Publication WO2016/123514, by mixing a Cas9 from *Streptococcus pyogenes* modified at the N-terminus with a polyglutamate peptide that includes at least 15 glutamate residues and modified at the C-terminus with a nuclear localization signal (NLS) with cationic arginine gold nanoparticles (ArgNPs). The Cas9/ArgNP nanoassemblies are delivered by infiltration (e. g., using mild positive pressure or negative pressure) into leaves of *Arabidopsis thaliana* plants. In one variation of the procedure, the Cas9/ArgNP nanoassemblies are co-delivered with at least one guide RNA (such as those described in Examples, 4, 5, 8, 9, 10, 12, and 13) to the *Arabidopsis* leaves. In other variations of the procedure, the self-assembled Cas9/ArgNP nanoassemblies are prepared with at least one guide RNA to allow the modified Cas9 to form a ribonucleoprotein (RNP) either prior to or after formation of the nanoassemblies; the self-assembled RNP/ArgNP nanoassemblies are then delivered to the *Arabidopsis* leaves. Efficiency of editing is assessed by any suitable method such as a heteroduplex cleavage assay or by sequencing, as described elsewhere in this disclosure.

One of skill in the art would recognize that alternatives to the above compositions and procedures can be used to edit plant cells and intact plants, tissues, seeds, and callus. In embodiments, nanoassemblies are made using other sequence-specific nucleases (e. g., zinc-finger nucleases (ZFNs), transcription activator-like effector nucleases (TAL-effector nucleases or TALENs), Argonaute proteins, or a meganuclease or engineered meganuclease) which can be similarly charge-modified. In embodiments, nanoassemblies are made using other nanoparticles (e. g., nanoparticles made of materials such as carbon, silicon, silicon carbide, gold, tungsten, polymers, ceramics, iron oxide, or cobalt ferrite) which can be similarly charge-modified in order to form non-covalent complexes with the charge-modified sequence-specific nuclease. Similar nanoassemblies including other polypeptides (e. g., phosphatases, hydrolases, oxidoreductases, transferases, lyases, recombinases, polymerases, ligases, and isomerases) or polynucleotides or a combination of polypeptides and polynucleotides are made using similar charge modification methods to enable non-covalent complexation with charge-modified nanoparticles. For example, similar nanoassemblies are made by complexing charge-modified nanoparticles with one or more polypeptides or ribonucleoproteins including at least one functional domain selected from the group consisting of: transposase domains, integrase domains, recombinase domains, resolvase domains, invertase domains, protease domains, DNA methyltransferase domains, DNA hydroxylmethylase domains, DNA demethylase domains, histone acetylase domains, histone deacetylase domains, nuclease domains, repressor domains, activator domains, nuclear-localization signal domains, transcription-regulatory protein (or transcription complex recruiting) domains, cellular uptake activity associated domains, nucleic acid binding domains, antibody presentation domains, histone modifying enzymes, recruiter of histone modifying enzymes, inhibitor of histone modifying enzymes, histone methyltransferases, histone demethylases, histone kinases, histone phosphatases, histone ribosylases, histone deribosylases, histone ubiquitinases, histone deubiquitinases, histone biotinases, and histone tail proteases.

Example 9

As described herein, microinjection techniques can be used as an alternative to the methods for delivering targeting agents to protoplasts as described, e.g., in certain Examples above. Microinjection is typically used to target specific cells in isolated embryo sacs or the shoot apical meristem. See, e.g., U.S. Pat. No. 6,300,543, incorporated by reference herein. For example, an injector attached to a Narashige manipulator on a dissecting microscope is adequate because the cells to be microinjected are relatively large (e.g., the egg/synergids/zygote and the central cell). For smaller cells, such as those of the embryo, a compound, inverted microscope with an attached Narashige manipulator is used. Injection pipette diameter and bevel are also important. Use a high quality pipette puller and beveler to prepare needles with adequate strength, flexibility and pore diameter. These will vary depending on the cargo being delivered to cells. The volume of fluid to be microinjected must be exceedingly small and must be carefully controlled. An Eppendorf Transjector yields consistent results (Laurie et al., 1999).

The genetic cargo can be RNA, DNA, protein or a combination thereof. The cargo can be designed to change one aspect of the target genome or many. The concentration of each cargo component will vary depending on the nature of the manipulation. Typical cargo volumes can vary from 2-20 nanoliters. After microinjection the embryos are maintained on an appropriate media alone (e.g., sterile MS medium with 10% sucrose) or supplemented with a feeder culture. Plantlets are transferred to fresh MS media every two weeks and to larger containers as they grow. Plantlets with a well-developed root system are transferred to soil and maintained in high-humidity for 5 days to acclimate. Plants are gradually exposed to the air and cultivated to reproductive maturity.

Microinjection of corn embryos: The cobs and tassels are immediately bagged when they appear to prevent pollination. To obtain zygote-containing maize embryo sacs, hand pollination of silks is performed when the silks are 6-10 cm long, the pollinated ears are bagged and tassels removed, and then ears are harvested at 16 hours later. After removing husks and silks, the cobs are cut transversely into 3 cm segments. The segments are surface sterilized in 70% ethanol and then rinsed in sterile distilled, deionized water. Ovaries are then removed and prepared for sectioning. The initial preparation may include mechanical removal of the ovarian wall, but this may not be required.

Once the ovaries have been removed, they are attached to a Vibratome sectioning block, an instrument designed to produce histological sections without chemical fixation or embedment. The critical attachment step is accomplished using a commercial adhesive such as Locktite cement. Normally 2-3 pairs of ovaries are attached on each sterile sectioning block with the adaxial ovarian surface facing upwards and perpendicular to the longitudinal axis of the rectangular sectioning block (Laurie et al., *In Vitro Cell Dev Biol.*, 35: 320-325, 1999). Ovarian sections (or "nucellar slabs") are obtained at a thickness of 200 to 400 micrometers. Ideal section thickness is 200 micrometers. The embryo sac will remain viable if it is not cut. The sections are collected with fine forceps and evaluated on a dissecting microscope with basal illumination. Sections with an intact embryo sac are placed on semi-solid Murashige-Skoog (MS) culture medium (Campenot et al., 1992) containing 15% sucrose and 0.1 mg/L benzylaminopurine. Sterile Petriplates containing semi-solid MS medium and nucellar slabs are then placed in an incubator maintained at 26° C. These can be monitored visually by removing plates from the incubator and examining the nucellar slabs with a dissecting microscope in a laminar flow hood.

Microinjection of soy embryonic axes: Mature soybean seeds are surface sterilized using chlorine gas. The gas is cleared by air flow in a sterile, laminar flow hood. Seeds are wetted with 70% ethanol for 30 seconds and rinsed with sterile distilled, deionized water then incubated in sterile distilled, deionized water for 30 minutes to 12 hours. The embryonic axes are carefully removed from the cotyledons and placed in MS media with the radicle oriented downwards and the apex exposed to air. The embryonic leaves are carefully removed with fine tweezers to expose the shoot apical meristem.

Microinjection of rice: Rice tissues that are appropriate for genome editing manipulation include embryogenic callus, exposed shoot apical meristems and 1 DAP embryos. There are many approaches to producing embryogenic callus (for example, Tahir 2010 (doi:10.1007/978-1-61737-988-8_21); Ge et al., 2006 (doi:10.1007/s00299-005-0100-7)). Shoot apical meristem explants can be prepared using a variety of methods in the art (see, e.g., Sticklen and Oraby, 2005 (doi:10.1079/IVP2004616); Baskaran and Dasgupta, 2012 (doi:10.1007/s13562-011-0078-x)). This work describes how to prepare and nurture material that is adequate for microinjection.

To prepare 1 DAP embryos for microinjection, Indica or japonica rice are cultivated under ideal conditions in a greenhouse with supplemental lighting with a 13-hour day, day/night temperatures of 30°/20° C., relative humidity between 60-80%, and adequate fertigation using Hoagland's solution or an equivalent. The 1 DAP zygotes are identified and prepped essentially as described in Zhang et al., 1999, *Plant Cell Reports* (doi:10.1007/s002990050722). The dissected ovaries with exposed zygotes are placed on the appropriate solid support medium and oriented for easy access using a microinjection needle. Injection and subsequent growth is carried out as described above in this Example.

Microinjection of tomato: Tomato tissues that are appropriate for genome editing manipulation include embryogenic callus, exposed shoot apical meristems and 1 DAP embryos. There are many approaches to producing embryogenic callus (for example, Toyoda et al., 1988 (doi:10.1007/BF00269921), Tahir 2010 (DOI 10.1007/978-1-61737-988-8_21), Ge et al., 2006 (doi:10.1007/s00299-005-0100-7), Senapati, 2016 (doi: 10.9734/ARRB/2016/22300)). Shoot apical meristem explants can be prepared using a variety of methods in the art (Sticklen and Oraby, 2005 (doi: 10.1079/IVP2004616), Baskaran and Dasgupta, 2012 (doi: 10.1007/s13562-011-0078-x), Senapati, 2016 (doi:10.9734/ARRB/2016/22300)). This work describes how to prepare and nurture material that is adequate for microinjection.

To prepare one day after germination seedlings for microinjection, tomato seed are germinated under ideal conditions in a growth chamber with supplemental lighting for a 16-hour day, day/night temperatures of 25/20° C., and relative humidity between 60-80%. The one day after germination seedlings are identified and prepped essentially as described in Vinoth et al., 2013 (doi: 10.1007/s12010-012-0006-0). Germinated seeds with 2-3 mm meristems are placed on the appropriate solid support medium and oriented for easy access using a microinjection needle. Injection and subsequent growth is carried out as described above in this Example.

Example 10

This example illustrates a method of changing expression of a sequence of interest in a genome, comprising integrating sequence encoded by a polynucleotide (such as a double-stranded DNA, a single-stranded DNA, a single-stranded DNA/RNA hybrid, or a double-stranded DNA/RNA hybrid) donor molecule at the site of at least one double-strand break (DSB) in a genome. More specifically, this non-limiting example illustrates using a ribonucleoprotein (RNP) including a guide RNA (gRNA) and a nuclease to effect a DSB in the genome of a plant, and integration of sequence encoded by a double-stranded DNA (dsDNA) at the site of the DSB, wherein the dsDNA molecule includes a sequence recognizable by a specific binding agent, and wherein contacting the integrated sequence encoded by dsDNA molecule with the specific binding agent results in a change of expression of a sequence of interest. In this particular example, the sequence recognizable by a specific binding agent includes a recombinase recognition site sequence, the specific binding agent is a site-specific recombinase, and the change of expression is upregulation or downregulation or expression of a transcript having an altered sequence (for example, expression of a transcript that has had a region of DNA excised, inverted, or translocated by the recombinase).

The loxP ("locus of cross-over") recombinase recognition site and its corresponding recombinase Cre, were originally identified in the P1 bacteriophage. The wild-type loxP 34 base-pair sequence is

ATAACTTCGTATAGCATACATTATACGAAGTTAT (SEQ ID NO: 7)

and includes two 13 base-pair palindromic sequences flanking an 8 base-pair spacer sequence; the spacer sequence, shown in underlined font, is asymmetric and provides directionality to the loxP site. Other useful loxP variants or recombinase recognition site sequence that function with Cre recombinase are provided in Table 2.

TABLE 2

| SEQ ID NO: | Cre recombinase recognition site | Sequence |
|---|---|---|
| 7 | LoxP (wild-type 1) | ATAACTTCGTATAGCATACATTATACGAAGTTAT |
| 8 | LoxP (wild-type 2) | ATAACTTCGTATAATGTATGCTATACGAAGTTAT |
| 9 | Canonical LoxP | ATAACTTCGTATANNNTANNNTATACGAAGTTAT |
| 10 | Lox 511 | ATAACTTCGTATAATGTATACTATACGAAGTTAT |
| 11 | Lox 5171 | ATAACTTCGTATAATGTGTACTATACGAAGTTAT |
| 12 | Lox 2272 | ATAACTTCGTATAAAGTATCCTATACGAAGTTAT |
| 13 | M2 | ATAACTTCGTATAAGAAACCATATACGAAGTTAT |

TABLE 2-continued

| SEQ ID NO: | Cre recombinase recognition site | Sequence |
|---|---|---|
| 14 | M3 | ATAACTTCGTATATAATACCATATACGAAGTTAT |
| 15 | M7 | ATAACTTCGTATAAGATAGAATATACGAAGTTAT |
| 16 | M11 | ATAACTTCGTATAAGATAGAATATACGAAGTTAT |
| 17 | Lox 71 | TACCGTTCGTATANNNTANNNTATACGAAGTTAT |
| 18 | Lox 66 | ATAACTTCGTATANNNTANNNTATACGAACGGTA |

Cre recombinase catalyzes the recombination between two compatible (non-heterospecific) loxP sites, which can be located either on the same or on separate DNA molecules. Thus, in embodiments of the invention, polynucleotide (such as double-stranded DNA, single-stranded DNA, single-stranded DNA/RNA hybrid, or double-stranded DNA/RNA hybrid) molecules including compatible recombinase recognition sites sequence are integrated at the site of two or more double-strand breaks (DSBs) in a genome, which can be on the same or on separate DNA molecules (such as chromosomes). Depending on the number of recombinase recognition sites, where these are integrated, and in what orientation, various results are achieved, such as expression of a transcript that has had a region of DNA excised, inverted, or translocated by the recombinase. For example, in the case where one pair of loxP sites (or any pair of compatible recombinase recognition sites) are integrated at the site of DSBs in the genome, if the loxP sites are on the same DNA molecule and integrated in the same orientation, the genomic sequence flanked by the loxP sites is excised, resulting in a deletion of that portion of the genome. If the loxP sites are on the same DNA molecule and integrated in opposite orientation, the genomic sequence flanked by the loxP sites is inverted. If the loxP sites are on separate DNA molecules, translocation of genomic sequence adjacent to the loxP site occurs. Examples of heterologous arrangements or integration patterns of recombinase recognition sites and methods for their use, particularly in plant breeding, are disclosed in U.S. Pat. No. 8,816,153 (see, for example, the Figures and working examples), the entire specification of which is incorporated herein by reference.

One of skill in the art would recognize that the details provided here are applicable to other recombinases and their corresponding recombinase recognition site sequences, such as, but not limited to, FLP recombinase and frt recombinase recognition site sequences, R recombinase and Rs recombinase recognition site sequences, Dre recombinase and rox recombinase recognition site sequences, and Gin recombinase and gix recombinase recognition site sequences.

Example 11

In jointless-2 (j2, GeneID, 101263981) mutants, the fruit can be detached from the plant without the pedicel. The pedicel must be removed at harvest to prevent puncture injury in the bins of harvested fruit. Currently j2 is used in processing tomatoes that are machine harvested but not in fresh market varieties where the pedicel must be removed from each harvested fruit at the time of picking. Although this time-consuming procedure incurs major labor cost, the classical j1 mutation is not used because of negative effects on fruit shape and yield. In contrast to jointless-1, work from Lippman and colleagues shows that j2 mutants have little or no pleiotropic effect on fruit shape (doi: 10.1016/j.cell.2017.04.032).

The sequence of J2 gene exon 2 to exon 3 (582 bp, 9153-9735 bp downstream of TSS, exons are in uppercase) is:

(SEQ ID NO: 894)
CATGATGACAACACTTGAAAAGTATCAACAATGCAGTTACGCATCTTTGG

ACCCGATGTTACCGGTTAGTGATACTCAGgtattgtttatctactttatc atgtcgtaagtatattatttgtaaagatatatatcaagatagttcgattg cgtacacttacattttgattatgtttggtgaatactattctaataccttt tttttcctaaagcctaacaaataaagataattaagatgggaacgtaatt caagtacaacatggttccatacgtgacatatttacacatatagtggaacc aaaagagcaattttcctaatatcattttctaaatatcacgtgtgcccgt gattcttttttatggacatgaattttttttttaatatgagtggaagtaag gttcgatctttctatctgctttgatatcatattgaatcgtgtgattgtct cttaaaaaattaagcaagagcatattttattaattaattgtctttctcg acgttttctctttcaacagATGAACTACAATGAGTATGTGAGGCTAAAA

GCTAGAGTTGAGCTCCTTCAACGTTCTCAAAG.

Two RNP with cutting sites at 9211 bp and 9691 bp downstream of TSS are delivered to cells together to knock-out J2 gene. The crRNA sequences are (SEQ ID NO: 895)
GUAUCACUAACCGGUAACAUGUUUUAGAGCUAUGCU
and (SEQ ID NO: 896)
UGAACUACAAUGAGUAUGUGGUUUUAGAGCUAUGCU.

As an exemplary assay for readout, QPCR can be used to check the transcript level of J2 and CRISPR amplicon sequencing can be used to confirm the loss-of-function editing and phenotypic readout of edited plants with jointless pedicels.

Example 12

SELF-PRUNING (SP, GeneID, 544038) gene maintain the indeterminate state of inflorescence meristems in tomato. All determinate varieties are mutated in both copies of SP. Almost all of the high flavor heirloom varieties are indeterminate. Using CRISPR to knockout the SP gene in appropriate parents to create determinate growth varieties suitable for field production with extremely tasty, highly productive tomatoes.

The sequence of SP gene $1^{st}$ exon (204 bp) is:

(SEQ ID NO: 897)
ATGGCTTCCAAAATGTGTGAACCCCTTGTGATTGGTAGAGTGATTGGTGA

AGTTGTTGATTATTTCTGTCCAAGTGTTAAGATGTCTGTTGTTTATAACA

ACAACAAACATGTCTATAATGGACATGAATTCTTTCCTTCCTCAGTAACT

TCTAAACCTAGGGTTGAAGTTCATGGTGGTGATCTCAGATCCTTCTTCAC

ACTG.

Two RNP with cutting sites at 107 bp and 253 bp downstream of TSS are delivered to cells together to knock-out SP gene. The crRNA sequences are (SEQ ID NO: 898)
AUCACUCUACCAAUCACAAGGUUUUAGAGCUAUGCU
and (SEQ ID NO: 899)
CCUAGGGUUGAAGUUCAUGGGUUUUAGAGCUAUGCU.

As an exemplary assay for readout, QPCR can be used to check the transcript level of SP, and CRISPR amplicon sequencing can be used to confirm the loss-of-function editing and phenotypic readout of edited plants with determinate growth.

Example 13

The fruit specific β-carotene formation is mediated by a chloroplast-specific paralog of lycopene beta cyclase (CYC-B, OLD-GOLD-CRIMSON, GeneID: 543649). There have been concerted efforts to alter the lycopene levels in tomato by introgression of genes from its wild relatives and by mutations. The loss of function mutation in CYC-B gene can lead to increase in lycopene level, whereas gain of function can lead to high β-carotene level. Consumers respond very positively to the high lycopene level and the associated increase in internal red color. The old-gold-crimson ($og^c$) mutants of tomato have high lycopene accumulation in fruits due to null mutations in the CYC-B gene (doi: 10.1073/pnas.190177497).

The sequence of the CYC-B $1^{st}$ exon (400 bp, 107-506 bp downstream of TSS) is (SEQ ID NO: 900)
ATGGAAACTCTTCTCAAGCCTTTTCCATCTCTTTTACTTTCCTCTCCTA

CACCCTATAGGTCTATTGTCCAACAAAATCCTTCTTTTCTAAGTCCCAC

CACCAAAAAAAATCAAGAAAATGTCTTCTTAGAAACAAAAGTAGTAAA

CTTTTTTGTAGCTTTCTTGATTTAGCACCCACATCAAAGCCAGAGTCTT

TAGATGTTAACATCTCATGGGTTGATCCTAATTCGAATCGGGCTCAATT

CGACGTGATCATTATCGGAGCTGGCCCTGCTGGGCTCAGGCTAGCTGAA

CAAGTTTCTAAATATGGTATTAAGGTATGTTGTGTTGACCCTTCACCAC

TCTCCATGTGGCCAAATAATTATGGTGTTTGGGTTGATGAGTTTGAGAA

TTTAGGAC.

Two RNP with cutting sites at 153 bp and 455 bp downstream of TSS are delivered to cells together to knock-out CYC-B gene. The crRNA sequences are (SEQ ID NO: 901)
AGACCUAUAGGGUGUAGGAGGUUUUAGAGCUAUGCU
and (SEQ ID NO: 902)
ACCCUUCACCACUCUCCAUGGUUUUAGAGCUAUGCU.

As an exemplary assay for readout, QPCR can be used to check the transcript level of CYC-B and CRISPR amplicon sequencing can be used to confirm the loss-of-function editing. The lycopene content level of edited plants is measured following the method (doi: 10.1073ypnas.190177497).

Example 14

MS10 (MALE STERILE, GeneID: 101261687) encodes a basic helix-loop-helix transcription factor that is specifically expressed in meiocyte and tapetal tissue from pre-meiotic to tetrad stages. The ms10 mutant exhibited dysfunctional meiosis and abnormal tapetum during anther development, resulting in no pollen production (doi: 10.1093/jxb/eru389). Knockout MS10 could generate a male sterile line to reduce the cost of hybrid seed production.

The sequences of MS10 1$^{st}$ exon and 2$^{nd}$ exon (630-1080 bp downstream of TSS, exons are in uppercase) is:

(SEQ ID NO: 903)
ATGACAAAAGAAACCATAATCACTGACGCCATCACCTACATTAGGGAGCT

ACAAATGAATGTGGACAACCTAAGTGAGCAGCTTCTTGAAATGGAAGCAA

CTCAGGGGGAGGAACTGGAGACAAAAAATGAAGAGATTATCGATACTGCA

GACGAGATGGGTAAATGGGGCATAGAGgtaggtaactttatgtataaaac caaagtttcaatctttgatattcttgaattataaggacagtaaaacaact ttgatctttgttttctaaaacagCCTGAAGTTCAAGTGGCTAACATTGG

CCCAACTAAGCTTTGGATAAAAATAGTCTGCCAAAAGAAAAGAGGTGGAT

TAACTAAACTGATGGAGGCAATGAATGCTCTTGGATTTGATATAAATGAC

ACCAGTGCCACTGCCTCTAAAGGAGCTATTCTTATTACTTCATCTGTGGA

G.

Two RNP with cutting sites at 732 bp and 991 bp downstream of TSS are delivered to cells together to knockout MS10 gene. The crRNA sequences are (SEQ ID NO: 904)
UGAAAUGGAAGCAACUCAGGGUUUUAGAGCUAUGCU
and (SEQ ID NO: 905)
UGGAUUAACUAAACUGAUGGGUUUUAGAGCUAUGCU.

As an exemplary assay for readout, CRISPR amplicon sequencing can be used to confirm the loss-of-function editing and confirm the editing plants with male sterile phenotype.

Example 15

Powdery mildew is a common disease of higher plant species. The disease is particularly prevalent in temperate and humid climates, where it frequently causes significant yield losses in greenhouse and field tomato farming. In barley, pea and tomato, mutations in the MLO gene (MILDEW RESISTANCE LOCUS O, GeneID: 778228) result in increased powdery mildew resistance (doi: 10.1094/MPMI-21-1-0030). So knockout of MLO gene in tomato can increase powdery mildew resistance.

The sequence of MLO exon 1-3 (174-681 bp downstream of TSS, exons are in uppercase) is (SEQ ID NO: 906)
ATGGCTAAAGAACGGTCTATGGAGGCAACCCCTACGTGGGCAATTGCTGT

GGTTTGCTTCATCTTGCTCGCTATTTCTATTTTTATTGAACAAATTATTC

ATCACATTGGAGAGgtacctactatataatttcaaaatctttactagat cgatatgaacaaaatatgcttattaattgttgggaaaaccattttctttt ttagTGGTTACTGGAAAAGCGGAAAAAGTCTCTATATGAAGCACTTGAAA AGATCAAAGCTGgtaaattcaaaatacagtcttgtattataaaataatat agtttaaagatggatcatactcatgacattttttggtgtgtgtgtcgga cagAACTTATGCTGTTGGGATTCTTATCACTGTTGTTGACAGTGTTGCAA

GATCCAGTTTCTAACTTATGTGTCCCCAAGAGTGTTGGTTATTCATGGCA

TCCTTGTATGGCAAAGGAAGATGCCAAGTCTGAGTATGATGACCCTTGTC

TACCAAAG.

Two RNP with cutting sites at 209 bp and 602 bp downstream of TSS are delivered to cells together to knockout MLO gene. The crRNA sequences are (SEQ ID NO: 907)
ACCACAGCAAUUGCCCACGUGUUUUAGAGCUAUGCU
and (SEQ ID NO: 908)
AUGAAUAACCAACACUCUUGGUUUUAGAGCUAUGCU.

As an exemplary assay for readout, QPCR can used to check the transcript level of MLO and CRISPR amplicon sequencing can be used to confirm the loss-of-function editing.

Example 16

The major feature of tomato domestication was a dramatic increase in fruit size, caused in large by an increase in the number of carpels in flowers and thus seed compartments (locules) in fruits. The CLAVATA (CLV) signaling pathway restricts stem cell proliferation and meristem size. The fasciated and branched (fab) mutant is defective in the receptor kinase CLV1 (GeneID, 101266413) and produces larger fruits as a consequence of additional carpels. Knockout of CLV1 using CRISPR could increase locule number and fruit size.

The sequence of CLV1 1$^{st}$ exon (167-1001 bp downstream of TSS) is (SEQ ID NO: 909)
ATGTCACTACCCAAAAAAATATCCCTTTTCCTCCAAATTTTCATCTTTTT

TGTTTTCACCATTAATGCAAACTCTGATCTTGAAGCCCTTTTGAAGCTCA

AAGAATCCATGGTTGCTCCTGGAACTTCTGCACTTCTTGATTGGAACAAC

AACACAAAAAATTACCCTTTTTCCCATTGTTCTTTTTCTGGTATTACATG

TAACAATAACTCTCATGTTATATCTATTAACATCACTAATGTTCCTCTAT

TTGGTACTATTCCACCTGAAATTGGTCTTTTACAAAATCTTGAAAATCTT

ACTATTTTTGGTGATAATCTTACTGGTACACTCCCTTTAGAAATGTCACA

ACTTTCTTCTATTAAACATGTTAATCTTTCTTACAACAATTTTTCTGGTC

CTTTTCCAAGAGAAATCCTGTTGGGGTTAATAAAGCTTGAATCTTTTGAC

```
ATTTATAACAACAATTTCACTGGTGAACTTCCTATTGAGGTTGTAAAGTT

GAAAAATTTGGAAACTTTACATCTTGGTGGAAACTATTTTCATGGTGAAA

TACCAGAAGTTTATTCCCATATTGTAAGTTTAAAGTGGTTGGGTTTAGAG

GGAAATTCACTTACTGGGAAAATACCAAAGAGTTTGGCTTTGTTACCAAA

TCTTGAAGAACTTAGATTGGGTTACTATAATAGTTATGAAGGGGGTATTC

CATCTGAGTTTGGTAATATTAGTACACTTAAACTTCTTGATCTTGGAAAT

TGTAATCTTGATGGTGAAGTTCCTCCAAGTCTTGGAAATTTGAAGAAGTT

GCATTCTTTGTTTCTACAAGTGAACAGACTTACAG.
```

Two RNP with cutting sites at 278 bp and 854 bp downstream of TSS are delivered to cells together to knock-out CLV1 gene. The crRNA sequences are

```
                                         (SEQ ID NO: 910)
AGAAGUUCCAGGAGCAACCAGUUUUAGAGCUAUGCU
and
                                         (SEQ ID NO: 911)
UUACUAUAAUAGUUAUGAAGGUUUUAGAGCUAUGCU.
```

As an exemplary assay for readout, QPCR can be used to check the transcript level of CLV1, and CRISPR amplicon sequencing can be used to confirm the loss-of-function editing and phenotypic readout of edited plants with increased fruit size.

Example 17

LeNRT2.3 (GeneID, 543827) is a tomato nitrate transporter. Overexpression of LeNRT2.3 increased nitrate uptake in root and transport from root to shoot. Overexpression line of LeNRT2.3 also showed high biomass and fruit weight (doi: 10.1016/j.febslet.2015.03.016).

The sequence of LeNRT2.3 promoter (500 bp upstream of TSS) is

```
                                         (SEQ ID NO: 912)
cataattagaaaaaaaatccattttaccctttaattaaatgatttatac tgacaacttaaatatctcaaatttgttttgaccctaaatttgaaaata tactttatttttctgaaactttctgacgtcaaatgatataaagcagta ttattgatacgcccaaaggttctcaataaaccatgtcaaaaggagaagg ccatagagataatatatctaattatcaattaggattaaacaaaacaaga ataattaacaattaaacacaactatttatatagtggacattctttaag attccttataattaggatcctttgggatataccataaggttacattaac catttggaatctccattggttaacttaaaccctaatttgtcaactctt ttttacctatataaacccacctaaatcaatttcataaaattaaaacac atccctaattactcactaatcttgtttaattatcattttaatcactttt ttgttttttt.
```

The nitrate responsive element (NRE)

```
(AAGAGATGAGCTCTTGAGCAATGTAAAGGGTCAAGTTGTTTCT (SEQ ID NO: 913))
``` is inserted in Cas9/guide RNA cutting site, 340 bp, 182 bp, or 122 bp upstream of TSS. The crRNA sequences are

```
                                         (SEQ ID NO: 914)
AGUAUUAUUGAUACGCCCAAGUUUUAGAGCUAUGCU, (SEQ ID NO: 915)
AACCUUAUGGUAUAUCCCAAGUUUUAGAGCUAUGCU,
and
                                         (SEQ ID NO: 916)
AAAAAGAGUUGACAAAUUAGGUUUUAGAGCUAUGCU.
```

As an exemplary assay for readout, QPCR can be used to check the transcript level of LeNRT2.3 in the presence of high nitrate (10 mM KNO3) compared to the wild-type (non-edited). Biomass of seedlings of edited plants can be compared between high N (10 mM) and low N (0.1 mM).

Example 18

Systemin is a signal peptide that promotes the response to wounding and herbivore attack in tomato. The 18-amino acid peptide is released from a larger precursor, prosystemin (GeneID, 543989). Overexpression lines were more resistant against very different biotic stressors such as aphids, phytopathogenic fungi and phytophagous larvae (doi: 10.1007/s11105-014-0834-x).

The sequence of prosystemin promoter (600 bp upstream of TSS) is

```
                                         (SEQ ID NO: 917)
ttttagtattgctgtaccaaggtcgaatcttattgttaacacatattttt tacagagcacccacaaccttaaaataatgcaacgaccaaaattgtgatta tgcctgatttagtattaatatgattcaaatgattacttcattcgtccact tttatttgccatacattttttaaaaattaatttgactaattttaaagtt aaattaaattacattaactcatattttaaacaaaagaattagatatccaa aaactatatgaaaagtactatagattacaattttttacatataatataaa gaaaaaatgcatcttaaaatattagtcaaagttcttataacttaattata aaaatagaaattgtgacaaacaataattaaagaagaaagttcgaatttac tctcaaactttataattccaatataatatacattaattttttattaaacta atatatgtaacttaagtaatatgtcgtgtaagtataagaaactctcccaa ataggatttacatgtaaattcagattagttaaattttaatgtgaatatat atttcacgtgaaataataaatcaaaaaaaaaaaagaatgtcaacttttt.
```

The OCS element

```
(5'-/Phos/G*T*AAGCGCTT*A*C-3'  (SEQ ID NO: 918))
``` is inserted in Cas9/guide RNA cutting site, 578 bp, 449 bp, or 101 bp upstream of TSS to constitutively increase the expression of Prosystemin. The crRNA sequences are

```
                                         (SEQ ID NO: 919)
UUAACAAUAAGAUUCGACCUGUUUUAGAGCUAUGCU, (SEQ ID NO: 920)
AAAUGUAUGGCAAAUAAAAGGUUUUAGAGCUAUGCU,
and
                                         (SEQ ID NO: 921)
UAUAAGAAACUCUCCCAAAUGUUUUAGAGCUAUGCU.
```

As an exemplary assay for readout, QPCR can be used to check the transcript level of Prosystemin.

Example 19

Loss of day-length-sensitive flowering in tomato was driven by the florigen paralog and flowering repressor SELF-PRUNING 5G (SP5G, GeneID, 101254900). Soyk et al. (doi: 10.1038/ng.3733) showed that CRISPR/Cas9-engineered mutations in SP5G cause rapid flowering and enhance the compact determinate growth habit of field tomatoes.

The sequence of SP5G promoter (300 bp upstream of TSS) is (SEQ ID NO: 922)
gatgcgactttgtttgattatacttttccaaaggagagaattaagaga ttatatttggaattacgcagacaaaatttgaaagacatcttataagttt gaaatccaattacaagtggaatttaaaattttcacgacttgtcaaccat tgattctcaaataaagtgaaaaattattccaaaaacaaataaatattt ttttatgaccaaatatgtcctcaagaacatatgaaagctctctagtcat gagtataaataacaagggctagctagctcttgtctactcataaaatatc atccat.

The Silencer element (5'-/Phos/G*A* ATA TAT ATA TAT* T*C-3'

(SEQ ID NO: 923))

is inserted in Cas9/guide RNA cutting site, 271 bp, 189 bp, or 43 bp upstream of TSS to decrease the expression of SP5G. The crRNA sequences are (SEQ ID NO: 924)
UUUGAUUAUACUUUUUCCAAGUUUUAGAGCUAUGCU, (SEQ ID NO: 925)
GUUUGAAAUCCAAUUACAAGGUUUUAGAGCUAUGCU,
and (SEQ ID NO: 926)
GUCAUGAGUAUAAAUAACAAGUUUUAGAGCUAUGCU.

As an exemplary assay for readout, QPCR can be used to check the transcript level of SP5G.

Example 20

The major feature of tomato domestication was a dramatic increase in fruit size, caused in large by an increase in the number of carpels in flowers and thus seed compartments (locules) in fruits. QTL influencing tomato locule number include genes involved in the classical CLAVATA-WUSCHEL stem cell circuit, which controls meristem size. Mutations in the signaling peptide gene CLV3 (CLAVATA3, GeneID, 104644782), can cause meristem to enlarge and increase fruit size.

The sequence of CLV3 promoter (300 bp upstream of TSS) is (SEQ ID NO: 927)
gcaggggataaggtctctcgccctcctcaaactctacttgaaaaattac actgatgtattgtcgttgttgttattgttaactcaaactaaacacaaga taaatttaatctcattctttcttaaccaaagcctcttaactattttctt tgagcaaagtaaaattgaaagaatcaaataaataactgagatgagctca tctttatgtattgcctcagcatgtagaggatttcagaactgcactgtca tatcataaaaagtatacttatgatatacaacaatggctgcatggctcat catttt.

The Silencer element (SEQ ID NO:923) is inserted in Cas9/guide RNA cutting site, 274 bp, 165 bp, or 85 bp upstream of TSS to decrease the expression of CLV3. The crRNA sequences are (SEQ ID NO: 928)
UUUCAAGUAGAGUUUGAGGAGUUUUAGAGCUAUGCU, (SEQ ID NO: 929)
GCUCAAAGAAAAUAGUUAAGGUUUUAGAGCUAUGCU,
and (SEQ ID NO: 930)
CUGAAAUCCUCUACAUGCUGGUUUUAGAGCUAUGCU.

As an exemplary assay for readout, QPCR can be used to check the transcript level of CLV3 and its downstream target gene WUSCHEL. In addition, phenotypic readout of edited plants can be used to identify plants with a larger inflorescent meristem.

Example 21

Tomato becomes edible only after the fruit ripens. Current understanding of the genetic and molecular mechanisms involved in fruit ripening mainly comes from studies of various rare ripening tomato mutants including ripening inhibitor (rin) and COLORLESS NON-RIPENING (CNR, GeneID, 101256245). The CNR locus harbors an SBP-box gene, LeSPL-CNR, which belongs to the SQUAMOSA Promoter Binding Protein-like (SPL) TF family. Chen et al. (doi: 10.1038/srep07852) showed that SlymiR157 may provide a post-transcriptional mechanism for fine-tuning CNR expression through miRNA-induced mRNA cleavage or/and translation repression.

Deletion of SlymiR157

(5'-UUGACAGAAGAUAGAGAGCA-3' (SEQ ID NO: 931))

target site in the 3'UTR region of CNR can release the regulation of SlymiR157 and the expression level of CNR is expected to be increased.

The sequence of CNR 3'UTR (266 bp, miRNA target site 72-92 bp is underlined) is (SEQ ID NO: 932)
agaagcatcagcatcaatggcagccaaataacctactttctgaagcaaca taaacaagatgtgggttaagc<u>atgctctctatcttctgt</u>caattcccgga tttctaagcaaattgttatttgtgaccttcaagtatctagctaatagtac tttcatttcccttgtgtaaagggaaggacaaaaagaataagccgttggca ctgtctgctagtattcgaaaaatgaaatatttgtagtatgaatgcatatc catgttgacattccaa.

Cpf1/RNP with cutting sites at 2190 bp downstream of TSS is delivered to cells to destroy SlymiR157 target site. The crRNA sequence is (SEQ ID NO: 933)
UAAUUUCUACUCUUGUAGAUCUUAGAAAUCCGGGAAUUGAC.

As an exemplary assay for readout, QPCR can be used to examine the transcript level of CNR compared to the wild-type (non-edited).

Example 22

DMR6 (Downy Mildew Resistance 6, GeneID, 100736526) belongs to the superfamily of 2-oxoglutarate Fe(II) dependent oxygenases. DMR6 is specifically up-regulated during pathogen infection, and dmr6 mutants have increased SA levels that correlate with enhanced resistance to *Pseudomonas syringae*, *Hyaloperonospora arabidopsidis* and *Phytophthora capsici*. Thomazella et al (doi: 10.1101/064824) generated tomato plants with knockout of S1DMR6-1 gene do not have significant detrimental effects in growth and development and showed disease resistance against different pathogens, including *P. syringae*, *P. capsici* and *Xanthomonas* spp.

The sequences of DMR6 3'-UTR region (471 bp) is (SEQ ID NO: 934)
gtcgtttggttcatagggatgtcccggaagtaagtttagaattaaattta tactttgtttggttgagggtgagataaatctagacgttcaatcaaacaga atataaatttaatctcaaacttaatcctgaatatcccatccaatgccaat ataatttagtcagcaaaccaaatgacgcgaaatcataagtagtaccactt tcagtacttaattttttttttagattcgagttatagttctggggtgggaa ttaaactaggttgaaataagaaaaatggagacaccaattaccttgttgat ttacccaaattacatgactgctccaatgttttgttactgtcaagtagtgt tagcaatgggctggagaaatggactacgttggaataataataatttgta gcagtaatttcattgtttactgtatttacttcactgtatgagttattgaa ggctatgataatatattaaaa.

The mRNA destabilizing element (5'-/Phos/A*A*TTTTAATTTTAATTTTAATTTTAATTTTAATT*T*

T-3' (SEQ ID NO: 935))

(doi:10.1105/tpc.107.055046) is inserted in Cas9/guide RNA cutting site, 4611 bp, 4790 bp, or 4886 bp downstream of TSS. The crRNA sequences are (SEQ ID NO: 936)
UUUGGUUCAUAGGGAUGUCCGUUUUAGAGCUAUGCU, (SEQ ID NO: 937)
AAAAAAUUAAGUACUGAAAGGUUUUAGAGCUAUGCU,
and (SEQ ID NO: 938)
GUAAUUUGGGUAAAUCAACAGUUUUAGAGCUAUGCU.

As an exemplary assay for readout, QPCR can be used to check the transcript level of DMR6 in cells or seedlings of edited plants treated with 10 uM of flg22 peptide.

Example 23

SSP (SUPPRESSOR OF SP, GeneID, 100037508) encodes a basic region/leucine zipper (bZIP) transcription factor, a homolog of *Arabidopsis* FLOWERING LOCUS D (FD). The SSP mutants can transform determinate tomatoes into indeterminate with a "sympodial index" less than three (doi: 10.1038/ng.3131). To create knockout or weaker alleles of SSP have enormous value in breeding for higher yield tomato production.

The sequence of SSP 3'-UTR region (886 bp-1186 bp downstream of TSS, 3'-UTR is underlined) is (SEQ ID NO: 939)
gatcttattataatttggtttcctagtgctacattagtattaagaacaa tttcccatttggctgtattttgtttgtaatatgcaccaactgttgtttt gatggtggccttgtgggcgatgaatattcgtatgacaaaataagaagg gaaaaaataggttgtgaattaaggaaagtgtaggccattattagtactc tatcaaatagaaagacggtttagtctttttatggcaatgaaaacgatc tgcaactcatatttctgtatctattcatttgttccgtccacccccttc tatcta.

The mRNA destabilizing element (SEQ ID NO:935) (doi:10.1105/tpc.107.055046) is inserted in Cas9/guide RNA cutting site, 913 bp, 998 bp, or 1061 bp downstream of TSS. The crRNA sequences are (SEQ ID NO: 940)
CUUAAUACUAAUGUAGCACUGUUUUAGAGCUAUGCU, (SEQ ID NO: 941)
CGAAUAUUCAUCGCCCCACAGUUUUAGAGCUAUGCU,
and (SEQ ID NO: 942)
UUGUGAAUUAAGGAAAGUGUGUUUUAGAGCUAUGCU.

As an exemplary assay for readout, QPCR can be used to check the transcript level of SSP.

Example 24

SFT (SINGLE FLOWER TRUSS, GeneID, 101246029) encodes the ortholog of *Arabidopsis thaliana* FLOWERING LOCUS T (FT) and is the genetic originator of the flowering hormone florigen. In SFT mutants, loss of florigen results in highly vegetative plants with few flowers and fruits. However, when determinate plants are heterozygous for SFT mutations, a dose-dependent reduction in florigen activity weakly suppresses SP, resulting in more sympodial shoots and inflorescences (doi: 10.1038/ng.550). Thus to create weaker alleles of SFT have enormous value in breeding for higher yield tomato production.

The sequence of SFT 3'-UTR region (3931-4231 downstream of TSS, 3'-UTR is underlined) is (SEQ ID NO: 943)
tcaactccatctactacaaaaaaaaaaaaacaatgatattttagctaat aataaccaccaatatctactacttctcttacaactttagtagtatctata gttatcttttttaatctactcttttacttctttactatattgtcttcctc tcaatttatttgaattagtgacttgatatcaagtttcaataaagaaacaa agactgactttagaattttgtgatttacaataagttgtacatatttgtat gactatcttaaaaagttaaatcattattattaaatataaaaatatgatt.

The mRNA destabilizing element (SEQ ID NO:935) (doi:10.1105/tpc.107.055046) is inserted in Cas9/guide RNA cutting site, 3993 bp or 4084 bp downstream of TSS. The crRNA sequences are

```
                                        (SEQ ID NO: 944)
AGAGAAGUAGUAGAUAUUGGGUUUUAGAGCUAUGCU
and (SEQ ID NO: 945)
ACUAAUUCAAAUAAAUUGAGGUUUUAGAGCUAUGCU.
```

As an exemplary assay for readout, QPCR can be used to check the transcript level of SFT.

Example 25

LIN (LONG INFLORESCENCE, GeneID, 101253992) is a homolog of the *Arabidopsis* floral organ identity MADS-box gene SEPALLATA4 (SEP4). Knockout of LIN resulted in exceptionally long inflorescences with nearly twice as many flowers as WT and longer internodes. Weak allele of LIN with reduced expression could provide subtle increases in flower production with weak branching as branching often negatively impacts fruit weight and yield.

The sequence of LIN 3'-UTR region (4964-5263 downstream of TSS, 3'-UTR is underlined) is

```
                                        (SEQ ID NO: 946)
atgggaaacaagcaattaagtggttgaaagtttgagattggaaactaag aaccaataaatgtaatttcttgcatacatacaagttgagttttttgtgt ttcaaagactaactagcttgcatgtttagtaaactataatgatatatat ataaatatgtcatgtaataagtcaaacatacatttctattttggaccat ttctcgacttgtgcgtgatattcatactaatcttttttttatcgtttca attttctatgatatcattgaaggggactacattatctattctacttct tgtttt.
```

The mRNA destabilizing element (SEQ ID NO:935) (doi:10.1105/tpc.107.055046) is inserted in Cas9/guide RNA cutting site, 4980 bp or 5227 bp downstream of TSS. The crRNA sequences are

```
                                        (SEQ ID NO: 947)
AUGGGAAACAAGCAAUUAAGGUUUUAGAGCUAUGCU
and
                                        (SEQ ID NO: 948)
UUUCUAUGAUAUCAUUGAAGGUUUUAGAGCUAUGCU.
```

As an exemplary assay for readout, QPCR can be used to check the transcript level of LIN.

Example 26

The Bs2 (GenBank: AF202179.1) resistance gene of pepper specifically recognizes and confers resistance to strains of *Xanthomonas campestris* pv. *vesicatoria* that contain the corresponding bacterial avirulence gene, avrBs2. Functional expression of Bs2 in stable transgenic tomatoes supports its use as a source of resistance in other Solanaceous plant species (doi: 10.1073/pnas.96.24.14153).

Tomato Downy Mildew Resistance 6 (DMR6) belongs to the superfamily of 2-oxoglutarate Fe(II) dependent oxygenases. DMR6 is specifically up-regulated during pathogen infection. Knockout of S1DMR6 showed disease resistance against different pathogens. Knock-in of pepper Bs2 at S1DMR6 mRNA site could both knockout of DMR6 gene and also confer the resistance to *Xanthomonas*.

The sequence of Bs2 coding sequence (2718 bp) is

```
                                        (SEQ ID NO: 949)
ATGGCTCATGCAAGTGTGGCTTCTCTTATGAGAACAATAGAATCTCTCTT

GACATTCAATTCGCCGATGCAATCTCTATCCTGTGATCACAGAGAAGAAC

TTTGCGCTCTTCGTGAAAAAGTTAGTTCCCTGGAAGTATTTGTCAAGAAC

TTTGAGAAAAACAATGTTTTTGGGGAAATGACGGATTTTGAAGTAGAGGT

AAGAGAAGTTGCAAGTGCTGCTGAATACACAATTCAACTGAGACTAACAG

GAACTGTACTGGGAGAAAATAAAAGCCAGAAAAAAAAGGCGCGTCGAAGG

TTTCGTCAAAGCCTGCAACAAGTAGCAGAGGACATGGATCATATCTGGAA

AGAGTCGACAAAGATCCAAGATAAAGGAAAACAAGTATCAAAGGAATCAT

TGGTTCATGATTTTTCAAGTTCAACAAACGATATTTTGAAGGTTAAGAAC

AATATGGTTGGACGTGATGATCAAAGGAAACAGTTGTTAGAAGATCTGAC

TAGAAGCTACTCTGGGGAACCCAAAGTCATCCCGATTGTCGGGATGGGAG

GCATAGGTAAAACAACCTTAGCAAAAGAAGTTTACAATGATGAATCAATT

CTATGCCGTTTTGATGTTCATGCCTGGGCTACCATATCTCAACAGCACAA

CAAAAGGAAATTTTGCTGGGCCTTCTGCATTCCACAATCAAAATGGATG

ACAGGGTTAAGATGATTGGTGAAGCAGAGCTAGCAGACATGTTACAGAAA

AGTTTAAAGAGAAAGAGGTACTTAATTGTCTTGGATGATATCTGGAGTTG

TGAAGTGTGGGATGGCGTGAGACGATGCTTTCCAACTGAAGACAATGCAG

GGAGTCGAATACTGTTGACTACCCGTAATGATGAAGTAGCTTGTTATGCT

GGTGTAGAGAATTTTTCTTTGCGGATGAGCTTCATGGATCAAGATGAGAG

TTGGAGTCTTTTCAAAAGTGCAGCATTTTCAAGTGAAGCATTACCATATG

AGTTCGAGACTGTTGGAAAGCAAATCGCAGATGAATGTCACGGGTTACCA

CTAACTATTGTCGTGGTTGCAGGGCTTCTCAAATCTAAAAGGACAATAGA

AGATTGGAAAACTGTTGCTAAAGATGTCAAGTCATTCGTCACAAATGATC

CTGATGAACGATGTTCACGTGTGCTTGGGTTGAGTTACGATCACTTGACA

AGCGATCTAAAAACATGTCTTCTGCATTTCGGAATTTTTCCAGAAGACAG

TGATATTCCAGTGAAGAATTTGATGAGATCATGGATGGCTGAGGGGTTCC

TGAAGTTGGAAAATGATTTGGAAGGAGAGGTTGAGAAGTGTTTGCAAGAG

CTTGTCGATAGATGTCTAGTCCTCGTCAGCAAGAGAAGTCGAGATGGAAC

AAAAATTAGATCATGTAAGGTTCATGATCTAATATATGACCTGTGCGTGA

GAGAAGTTCAAAGGGAGAACATTTTTATCATGAACGACATTGTTCTTGAC

GTATCATATCCAGAATGTTCATATCTCTGTATGTATAAAATGCAGCCCTT

TAAGCGCGTGACTGGTGATGAAATTAATTATTGTCCCTATGGTCTTTATA

GGGCTCTTCTTACCCCTGTAAATCGTCAGTTGAGAGATCATGACAACAAC

AATCTTTTGAAACGAACCCATTCTGTTTTCTCTTTTCATCTTGAGCCTTT

ATATTATGTTCTCAAATCAGAGGTTGTTCATTTCAAATTACTCAAAGTCT

TGGAGCTGAGACACAGACAGATTGATGGTTTCCCTCGAGAGATACTAAGC

CTCATCTGGTTGAGGTACCTATCATTGTTCAGCTATGGGAATTTCGATGT
```

-continued

ACCTCCAGAAATTTGCAGGTTATGGAATCTGCAGACATTCATTGTTCAAC

GGTTTCGATCAGATATAATAATTTTTGCTGAGGAAATTTGGGAACTAATG

CAATTAAGGCATCTTAAACTGCCCAGATTTTATTTGCCAGATTGCCCAAG

TGGATCTGTTGACAAAGGAAGGCACTTGGATTTTTCAAACTTACAAACTA

TTTCTTACTTGTCTCCACGTTGTTGCACGAAGGAGGTTATTATGGGATT

CAGAATGTCAAAAAATTAGGAATCAGTGGAAATAAGGATGACTATAAAAG

TTTTCGGGACTCTGGGCTTCCCAACAATCTTGTCTATCTGCAGCAACTTG

AAATATTGAGTCTTATATCTGTTGATTATAGCCTTTTGCCAGTGATCATT

TCAAGTGCAAAAGCTTTTCCAGCAACGCTCAAGAAGTTGAAGTTGGAAAG

AACTTATCTAAGCTGGTCATACTTGGACATCATAGCTGAGTTGCCTAACC

TTGAGGTGCTGAAGCTGATGGATGACGCTTGTTGTGGTGAAGAATGGCAT

CCAATTGTTATGGGATTTAATCGATTGAAGCTTTTGCTAATTAAATATAG

TTTTCTCAAGTTCTGGAAAGCCACAAATGACAATTTTCCTGTCCTTGAGC

GCCTCATGATTAGAAGTTGCAAAAATTTGAAAGAGATACCCATTGAGTTT

GCAGATATACACACACTACAGCTGATTGAGTTAAGAGAGTGTCCTCCCAA

ACTTGGGGAATCTGCTGCACGAATTCAGAAAGAACAAGAAGACCTCGGAA

ACAACCCTGTGGATGTTCGTATCTCAAATCCATTGAAGGAGAGTGATTCT

GATTCAGAAGAACATTAG.

The Cas9/guide RNA has a cutting site at 116 bp downstream of TSS. The crRNA sequence is (SEQ ID NO: 950)
AUUAUAAGCCAUAGAUUCCAGUUUUAGAGCUAUGCU.

The donor template contains Bs2 CDS with flanking regions of 1 kb (underlined) is (SEQ ID NO: 951)
tttaggccctgtttcgtcatagatttctcaagtaatatttgggggggaaat ttgacaaatattgtttgttcatacaatttgtcataatttggcaaatattt ttgacaaatatcccaatttttcaaatactaatattttcatagtatatgaatc aaatctcattatttgggatcttttaaaaattaaaaatttacactaaactt ttatcttttacaaaaataccccctgtagtaattgtttgtgttgtattaca taattttttacgtaaacaccaaaatagtgatgaaatatttagtgaatatg aaagtgatgaaatgggttattgataaaaataatgaacaattggctcagg gtaataaagttgtgtgttttgtctacttcactgtgtatggaatgatactt gtttgactcactccaaaactatcacaattctcatggatactacttgttat ttgttgcaacgaagattcaattgacttaatacaaacttatggttagttgt tatagttttttaaatttatgttatattttataaaaaaataaaatatatt ttccaaatactatggctaaacacaaagagaaatttcacacaaattttcac tcatatctaattattttctatccgtgttaaatctcatttacttaataaaa aatcattaaaaaatatattattctatttaaaaatttgttttatctaagaa taattttagaagaagccgtatactagttatataaattcatcttaatttct tgtttagctaaataagagaaaattcaaatgatattttctaataatatta aataggtgcggtgatatgacacatggggataactagccctgtgtacctct ctatataatatgaactttctcagaaggatgaataagaatattgtgagcaa atcttctttcatttgtaattcaaaaattattactccttctttacttttcc aatttaattatatttatatgcaactccatatatattataagccatagatt

ATGGCTCATGCAAGTGTGGCTTCTCTTATGAGAACAATAGAATCTCTCTT

GACATTCAATTCGCCGATGCAATCTCTATCCTGTGATCACAGAGAAGAAC

TTTGCGCTCTTCGTGAAAAAGTTAGTTCCCTGGAAGTATTTGTCAAGAAC

TTTGAGAAAAACAATGTTTTTGGGGAAATGACGGATTTTGAAGTAGAGGT

AAGAGAAGTTGCAAGTGCTGCTGAATACACAATTCAACTGAGACTAACAG

GAACTGTACTGGGAGAAAATAAAAGCCAGAAAAAAAAGGCGCGTCGAAGG

TTTCGTCAAAGCCTGCAACAAGTAGCAGAGGACATGGATCATATCTGGAA

AGAGTCGACAAAGATCCAAGATAAAGGAAAACAAGTATCAAAGGAATCAT

TGGTTCATGATTTTTCAAGTTCAACAAACGATATTTTGAAGGTTAAGAAC

AATATGGTTGGACGTGATGATCAAAGGAAACAGTTGTTAGAAGATCTGAC

TAGAAGCTACTCTGGGGAACCCAAAGTCATCCCGATTGTCGGGATGGGAG

GCATAGGTAAAACAACCTTAGCAAAAGAAGTTTACAATGATGAATCAATT

CTATGCCGTTTTGATGTTCATGCCTGGGCTACCATATCTCAACAGCACAA

CAAAAAGGAAATTTTGCTGGGCCTTCTGCATTCCACAATCAAAATGGATG

ACAGGGTTAAGATGATTGGTGAAGCAGAGCTAGCAGACATGTTACAGAAA

AGTTTAAAGAGAAAGAGGTACTTAATTGTCTTGGATGATATCTGGAGTTG

TGAAGTGTGGGATGGCGTGAGACGATGCTTTCCAACTGAAGACAATGCAG

GGAGTCGAATACTGTTGACTACCCGTAATGATGAAGTAGCTTGTTATGCT

GGTGTAGAGAATTTTTCTTTGCGGATGAGCTTCATGGATCAAGATGAGAG

TTGGAGTCTTTTCAAAAGTGCAGCATTTTCAAGTGAAGCATTACCATATG

AGTTCGAGACTGTTGGAAAGCAAATCGCAGATGAATGTCACGGGTTACCA

CTAACTATTGTCGTGGTTGCAGGGCTTCTCAAATCTAAAAGGACAATAGA

AGATTGGAAAACTGTTGCTAAAGATGTCAAGTCATTCGTCACAAATGATC

CTGATGAACGATGTTCACGTGTGCTTGGGTTGAGTTACGATCACTTGACA

AGCGATCTAAAAACATGTCTTCTGCATTTCGGAATTTTTCCAGAAGACAG

TGATATTCCAGTGAAGAATTTGATGAGATCATGGATGGCTGAGGGGTTCC

TGAAGTTGGAAAATGATTTGGAAGGAGAGGTTGAGAAGTGTTTGCAAGAG

CTTGTCGATAGATGTCTAGTCCTCGTCAGCAAGAGAAGTCGAGATGGAAC

AAAAATTAGATCATGTAAGGTTCATGATCTAATATATGACCTGTGCGTGA

GAGAAGTTCAAAGGGAGAACATTTTTATCATGAACGACATTGTTCTTGAC

GTATCATATCCAGAATGTTCATATCTCTGTATGTATAAAATGCAGCCCTT

TAAGCGCGTGACTGGTGATGAAATTAATTATTGTCCCTATGGTCTTTATA

GGGCTCTTCTTACCCCTGTAAATCGTCAGTTGAGAGATCATGACAACAAC

AATCTTTTGAAACGAACCCATTCTGTTTTCTCTTTTCATCTTGAGCCTTT

ATATTATGTTCTCAAATCAGAGGTTGTTCATTTCAAATTACTCAAAGTCT

TGGAGCTGAGACACAGACAGATTGATGGTTTCCCTCGAGAGATACTAAGC

-continued

```
CTCATCTGGTTGAGGTACCTATCATTGTTCAGCTATGGGAATTTCGATGT

ACCTCCAGAAATTTGCAGGTTATGGAATCTGCAGACATTCATTGTTCAAC

GGTTTCGATCAGATATAATAATTTTTGCTGAGGAAATTTGGGAACTAATG

CAATTAAGGCATCTTAAACTGCCCAGATTTTATTTGCCAGATTGCCCAAG

TGGATCTGTTGACAAAGGAAGGCACTTGGATTTTTCAAACTTACAAACTA

TTTCTTACTTGTCTCCACGTTGTTGCACGAAGGAGGTTATTATGGGGATT

CAGAATGTCAAAAAATTAGGAATCAGTGGAAATAAGGATGACTATAAAG

TTTTCGGGACTCTGGGCTTCCCAACAATCTTGTCTATCTGCAGCAACTTG

AAATATTGAGTCTTATATCTGTTGATTATAGCCTTTTGCCAGTGATCATT

TCAAGTGCAAAAGCTTTTCCAGCAACGCTCAAGAAGTTGAAGTTGGAAAG

AACTTATCTAAGCTGGTCATACTTGGACATCATAGCTGAGTTGCCTAACC

TTGAGGTGCTGAAGCTGATGGATGACGCTTGTTGTGGTGAAGAATGGCAT

CCAATTGTTATGGGATTTAATCGATTGAAGCTTTTGCTAATTAAATATAG

TTTTCTCAAGTTCTGGAAAGCCACAAATGACAATTTTCCTGTCCTTGAGC

GCCTCATGATTAGAAGTTGCAAAAATTTGAAAGAGATACCCATTGAGTTT

GCAGATATACACACACTACAGCTGATTGAGTTAAGAGAGTGTCCTCCCAA

ACTTGGGGAATCTGCTGCACGAATTCAGAAAGAACAAGAAGACCTCGGAA

ACAACCCTGTGGATGTTCGTATCTCAAATCCATTGAAGGAGAGTGATTCT

GATTCAGAAGAACATTAGccatggaaaccaaagttatttctagcggaatc aaccactctactcttcctcaaagttacatccgacccgaatccgatagacc acgtctatcggaagtggtcgattgtgaaaatgttccaataattgacttaa gttgcggagatcaagctcaaataattcgtcaaattggagaagcttgtcaa acttatggtttctttcaggttcttatcgttggattcatgaattaataaat attttcgattattaacgataaaataataatcgactttactactttta ggtaattaatcatggtgtaccaaaggaagttgtagagaaaatgctagggg tagctggggaattttcaatttaccagtagaagagaaactaaaattatat tcagatgatccttcaaagaccatgagattatcaacaagttttaatgttaa aaaggagacagttcataattggagagattatctcagacttcattgttatc ctctagagaagtatgctcctgaatggccttctaatccatcatctttcagg taaacaccattaattaactgtttaactactttctttatgttaatatacat tgctatctgagtcatacttcaattattattatcattatatacgtcaacca ctttgtctgtatagtaatgcatggattggaagtaacctcaaataatatat cgtatgagatgttgtcaagtatctaagttgtttacgcgtataagagaaat acgaggctcaaactgagaagtgttgcatcctttaaaataagtgcatgtac atcacatatattaaaaaatagaacatgtgtcagatgcgtgtcagatgttt gtcaatattatagaatgtaaatatcctcaataaaatttcgttaaagaact acctaatatatatatatatataaaaataaatagttcttaattaggtaa taatttatttctttctaagaagagtcaactcattcaaaatatatatttat aaaaacataaaaataaaa.
```

As an exemplary assay for readout, QPCR can be used to confirm the expression of Bs2 gene and bacterial infection assay can be used to check the disease symptoms following the methods (doi: 10.1073/pnas.96.24.14153).

Example 27

LIN5 (Invertase 5, GeneID, 544241), an extracellular invertase, catalyses cleavage of sucrose in apoplast and its supply from source to sink organs in tomato. A *S. pennellii* quantitative trait locus (QTL) that increases sugar yield of tomatoes was mapped within LIN5 (doi: 10.1126/science.1101666). The complementation data indicate that Asp 348 plays a role in enhancing the activity of LIN5 and fruit sugar yield. Tiemnan et. al. (doi:10.1126/science.aal1556) showed fruit overexpressing the LIN5 Asn 366 changed to Asp contained significantly more sugar.

Tomato *S. lycopersicum* LIN5 Glu348 changed to Asp and Asn366 changed to Asp would increase fruit sugar content.

The sequence of LIN5 2nd exon region around Glu348 and Asn366 (300 bp, 2296-2596 bp downstream of TSS, Glu348 and Asn366 coding sequences are underlined) is (SEQ ID NO: 952)
```
ATATTCCGAATAACAATTCAATTGATGGTTGGAAGGGATTGAGAATCGA

CTATGGTAATTTCTATGCATCGAAGACATTCTATGATCCTAGCAGAAAT

CGAAGGGTTATTTGGGGTTGGTCAAATGAATCCGATGTATTACCTGACG

ATGAAATTAAGAAAGGATGGGCTGGAATTCAAGGTATTCCGCGACAAGT

ATGGCTAAACCTTAGTGGTAAACAATTACTTCAATGGCCTATTGAAGAA

TTAGAAACCCTAAGGAAGCAAAAGGTCCAATTGAACAACAAGAAGTTGA

GCAAGG.
```

The Cas9/guide RNA has cutting site at 2487 bp downstream of TSS. The crRNA sequence is (SEQ ID NO: 953)
AGGUUUAGCCAUACUUGUCGGUUUUAGAGCUAUGCU.

The donor template contains E348 mutated to D and N366 to D with flanking regions of 100 bp (underlined):

(SEQ ID NO: 954)
```
ATGGTAATTTCTATGCATCGAAGACATTCTATGATCCTAGCAGAAATCGA

AGGGTTATTTGGGGTTGGTCAAATGAATCCGATGTATTACCTGACGATGA

TATTAAGAAAGGATGGGCTGGAATTCAAGGTATTCCGCGACAAGTATGGC

TAGACCTTAGTGGTAAACAATTACTTCAATGGCCTATTGAAGAATTAGAA

ACCCTAAGGAAGCAAAAGGTCCAATTGAACAACAAGAAGTTGAGCAAGGG

AGA.
```

As an exemplary assay for readout, CRISPR amplicon sequencing can be used to confirm the A to T and A to G mutations.

Example 28

Abscisic acid (ABA) plays a crucial role in the plant response to both biotic and abiotic stresses. Mutations in PYR/PYL receptor proteins have been identified that result in hypersensitivity to ABA to enhance plant drought resistance (U.S. Patent Application Publication 2016/0194653). Mutation on S1PYR1 (PYRABACTIN RESISTANCE, GeneID, 101268417) E177 corresponding to the amino acid E141 in *Arabidopsis thaliana* PYR1 can enhance the sensitivity to ABA.

The sequence of S1PYR1 exon (201 bp, 488-688 bp downstream of TSS, the nucleotides encoding E177 are underlined) is (SEQ ID NO: 955)
GGATTTAGTATCATTGGCGGAGAACACCGGTTGAGGAATTACCGTTCAGT

TACGACGGTGCATGGATTCGAACGCGACGGAGAGATCTGGACGGTTGTTT

TGGAATCGTATGTTGTAGATGTACCGGAAGGGAATACGGAGGAAGATACA

CGCCTTTTCGCTGATACAGTTGTGAAATTGAACCTTCAGAAATTAGCTTC

T.

The amino acid sequence encoded by this region (with E177 underlined which is mutated to L to increase S1PYR1 sensitivity to ABA) is (SEQ ID NO: 956)
GFSIIGGEHRLRNYRSVTTVHGFERDGEIWTVVLESYVVDVPEGNTEEDT

RLFADTVVKLNLQKLAS.

The Cas9/guide RNA with cutting site at 575 bp downstream of TSS. The crRNA sequence is (SEQ ID NO: 957)
ACGCGACGGAGAGAUCUGGAGUUUUAGAGCUAUGCU.

The donor template contains E177 mutated to L with flanking regions of 100 bp (underlined) is (SEQ ID NO: 958)
ATTTAGTATCATTGGCGGAGAACACCGGTTGAGGAATTACCGTTCAGTTA

CGACGGTGCATGGATTCGAACGCGACGGAGAGATCTGGACGGTTGTTTTG

CTATCGTATGTTGTAGATGTACCGGAAGGGAATACGGAGGAAGATACACG

CCTTTTCGCTGATACAGTTGTGAAATTGAACCTTCAGAAATTAGCTTCTG

TT.

As an exemplary assay for readout, CRISPR amplicon sequencing can be used to confirm the GA to CT mutation. In addition, seedlings of edited plants can be treated with 10 uM ABA for 1 hour and then the expression level of ABA inducible genes can be measured (higher in edited seedlings compared to the wild-type control).

Example 29

Variants with highly branched inflorescences bearing hundreds of flowers arose more than a century ago due to loss-of-function mutations in a homeobox transcription factor encoded by the S gene (COMPOUND INFLORESCENCE, GeneID, 100240705). The extreme branching is driven by delaying the maturation of both apical and lateral meristems (doi:10.1073/pnas.1114963109). Homozygous s mutants have poor fertility due to flower abortion, but heterozygosity provides moderate branching and improved yield due to dosage sensitivity (doi:10.1016/j.cell.2017.04.032).

Higher methylation at the promoter of S gene can reduce its expression and generate a weaker epiallele for weak inflorescent branching.

Constructs for dCas9-SunTag and anti-GCN4 scFv fused to proteins involved in RNA-directed DNA methylation, for example, DEFECTIVE IN MERISTEM SILENCING3 (DMS3), the de novo DNA methyltransferase DOMAINS REARRANGED METHYLTRASFERASE2 (DRM2) or tobacco DRM catalytic domain (doi:10.1016/j.cell.2014.03.056) are used to target S gene promoter for increasing methylation.

The sequence of S gene promoter (300 bp upstream of TSS) is (SEQ ID NO: 959)
ttttagtttccttcatttaagcaaaatatcttgaaatgtgttttgtag taataaaaatgaccctcgagtcaatccaatacttcctttctttggccaa aacattcaaatctacaaagagcaattacttctcttccaccgttttctat tcaaatcctacaattacattatcttgactttcaaaaaaaaaaagtttc tttaccccaccccctaaaccccctaccccacttacttttctcccta tttattccttgctgcaacaacccctttaattctcattagaataatccaca cctttc.

Two guide RNAs targeting region in the promoter of S gene are designed to bring DNA methyltransferase or DMS3 to increase promoter methylation level. The crRNA sequences are (SEQ ID NO: 960)
AGGAUUUGAAUAGAAAACGGGUUUUAGAGCUAUGCU
and (SEQ ID NO: 961)
UUGCAGCAAGGAAUAAAUAGGUUUUAGAGCUAUGCU.

As an exemplary assay for readout, QPCR can be used to check the transcript level of S gene and bisulfite sequencing of the targeted methylation region in the promoter.

Example 30

This example describes the modification of two tomato genes to make double-determinate and early yield tomatoes.

Soyk et. al. (doi:10.1038/ng.3733) demonstrates that SP5G and SP repress flowering in different shoot systems and SP5G SP double knockout mutants in three yield trials provide a more rapid flowering burst and earlier fruit ripening. The double mutant reached final harvest 2 weeks sooner and the harvest index was always higher than that for SP single knockout plants.

The modification of the SP gene is described in Example 12. The gene modification for decreasing the expression of SP5G is described in Example 19.

As an exemplary assay for readout, QPCR can be used to check the transcript level of SP and SP5G. Edited plants are measured for flowering time.

Example 31

This example describes the modification of three tomato genes to make tomatoes with inflorescence architecture and higher yield.

Three meristem expressed MADS-box transcription factors EJ2, J2 and LIN modulate inflorescence complexity. They have overlapping roles in meristem maturation and inflorescence development. It has been shown that mutant alleles of these genes have dosage effect on meristem maturation and can be combined to improve inflorescence architecture and yield.

The sequence of 3'-UTR (5992-6283 bp downstream of TSS) of EJ2 (ENHANCER OF J2, GeneID, 543884) is (SEQ ID NO: 962)
tctgataattcgaacaagctaatccatgtttggttaaacagttatacagt aataatgtattgcatgtattatcatccttttttgttttgttgcaaatttt atttcgaaactctcttcaggaattatggcggcgatcgattaatcgaggac agtaaatgtaatgtatgcataagttgctactttaacatttgaaacctcct gaccatgcatttctgattgtatcacaatgtgtaattaaatggaattgttg tattttttgtatcattgaatcatatgcttatcttgtactata.

The mRNA destabilizing element (SEQ ID NO:935) (doi: 10.1105/tpc.107.055046) is inserted in Cas9/guide RNA cutting site, 6020 bp, 6116 bp or 5227 bp downstream of TSS. The crRNA sequences are (SEQ ID NO: 963)
UAUAACUGUUUAACCAAACAGUUUUAGAGCUAUGCU, (SEQ ID NO: 964)
ACUCUCUUCAGGAAUUAUGGGUUUUAGAGCUAUGCU,
and (SEQ ID NO: 965)
GUGAUACAAUCAGAAAUGCAGUUUUAGAGCUAUGCU.

Assay for readout, QPCR to check the transcript level of EJ2.

The disruption of the J2 gene is described in Example 11. The gene modification for decreasing the transcript stability of LIN is described in Example 25.

As an exemplary assay for readout, QPCR can be used to check the transcript level of EJ2, J2 and LIN and phenotypic readout can be used to monitor inflorescence architecture.

Example 32

This example describes the modification of two tomato genes to make tomatoes with resistance to powdery mildew, bacterial, and oomycete diseases.

MLO and DMR6 regulate the resistance to powdery mildew, bacterial, and oomycete diseases in tomato.

The disruption of the MLO gene is described in Example 15. The gene modification for decreasing the transcript stability of DMR6 is described in Example 22.

As an exemplary assay for readout, QPCR can be used to check the transcript level of MLO and DMR6. Edited plants are measured for resistance to powdery mildew, bacterial, and oomycete diseases.

Example 33

This example describes the preparation of reagents for the modification of three genes in tomato. It is predicted that the activation of these three genes will result in a tomato that produces capsaicin, the molecule that gives peppers their spicy taste. Peppers and tomatoes are closely related and share many genes. The genes involved in the biosynthesis of capsaicin in pepper were used to identify the homologous genes in tomato. Based on the pepper genome (see: doi: 10.1038/ng.2877) three genes were selected for modification and enhanced expression: capsaicin synthase (CS), BCAT, and KAS. Putative tomato homologues were identified by BLAST analysis and manual annotation.

A partial genomic sequence of the tomato capsaicin synthase (CS) gene (Solyc02g081740.1.1) is provided as (SEQ ID NO: 966)
ATAAGTATGTGCGTAAAAGTCTAAGTGGAGTCACGTGTGTATGATATGAG

GTCACATTAGAATTGTTACTAGAAAAGATATGAAGGAATCTTTTCATTTT

TATTTTATTTTCTTTTTACATAGAGTAAACAAAAAAAATTGACTGGAATT

GAAGTGGTAAGCCAAAAAATGTGAGAATACATGAAAAAGTGTGAGAGAAT

CACGTGTGTATGGTATGAGGTCACATGAATATTATTGCCGAAAATGGATA

TGAGAGAATCTTTTCATTTTTATTTTATTTTCTTTTTTAAACAGAGTAAA

AAAAATTAAGTGTGTATATATATATATGAGAAATGGGGAAACAAATTATC

AAACATAATTACCATTG.

CS is the last step in the synthesis of capsaicin. The expression of CS is constitutively increased by inserting an expression enhancing oligonucleotide in the 5' region of the gene. A maize OCS homologue (see Examples 18 encoded by a chemically modified single-stranded DNA with the sequence of SEQ ID NO:918 (Integrated DNA Technologies, Coralville, IA), phosphorylated on the 5' end and containing two phosphorothioate linkages at each terminus (i. e., the two linkages between the most distal three bases on either end of the strand) is designed for insertion at a double-strand break effected between nucleotides at positions 46/47, 216/217, and 333/334 of SEQ ID NO:966 in order to provide constitutively increased expression of CS. A CS crRNA is designed to target the nucleotides shown in bold italic in SEQ ID NO:966 and has the sequences of (SEQ ID NO: 967)
AGUCACGUGUGUAUGAUAUGGUUUUAGAGCUAUGCU, (SEQ ID NO: 968)
AGUCACGUGUGUAUGGUAUGGUUUUAGAGCUAUGCU,
and (SEQ ID NO: 969)
AUAUAUAUAUAUGAGAAAUGGUUUUAGAGCUAUGCU.

The crRNA and tracrRNA are purchased from Integrated DNA Technologies, Coralville, IA. Ribonucleoprotein (RNP) complexes are prepared using gRNA (crRNA: tracrRNA) and Cas9 nuclease (Aldevron, Fargo, ND).

The tomato BCAT gene (Solyc07g021630.2.1) has the partial genomic sequence of (SEQ ID NO: 970)
ATTACATAAAGATACAACTATAATCTGACCTAGCTTATAAAGGATGTGAA

ATCTAAAATGATGATATATACCTTGATAAAAAAATTTTGCTACATCGCCT

TTTGCAATTATTTCATTTTGAAAGTATTCATATTTGTTTATAAAAAATTT

TCAAATATTTTAATAAATAAATAAATAAAATTATATTTTATTTATGATTT

TCAAATATGTCAATGATATAAATGATTAGCTATAAATCTCATAAATTTCT

ATATAGACTTATTAAAATAAAGTATAAAAAGATTTTATTTTATTTTTGAA

ATACGAAAAATATGCGTGCTTGAGCCT*CTAACTACCTCCTATATAAATGA*

*TGAAAGAAAATGTT*AGGTGTGAGAAGTATATATCCTTATCCCAACTTTGG

-continued
AATTTCAAATCGTTTGATTATTAAGTTATTTGTTTGTTGTGGAAATTAAA

TATGATTCAAAGGG.

Expression of BCAT is constitutively IDC-80 DNA M increased by inserting an expression enhancing oligonucleotide in the 5' region of the gene. A maize OCS homologue (see Examples 18 encoded by a chemically modified single-stranded DNA with the sequence of SEQ ID NO:918 (Integrated DNA Technologies, Coralville, IA), phosphorylated on the 5' end and containing two phosphorothioate linkages at each terminus (i. e., the two linkages between the most distal three bases on either end of the strand) is designed for insertion at a double-strand break effected between nucleotides at positions 103/104, 330/331, or 362/363 of SEQ ID NO: 970 in order to provide constitutively increased expression of BCAT. Three BCAT crRNAs are designed to target the nucleotides shown in bold italic in SEQ ID NO:970 and have the sequences of (SEQ ID NO: 971)
UUUAUAUAGGAGGUAGUUAGGUUUUAGAGCUAUGCU, (SEQ ID NO: 972)
CAAAAUGAAAUAAUUGCAAAGUUUUAGAGCUAUGCU,
and (SEQ ID NO: 973)
AAAUGAUGAAAGAAAAUGUUGUUUUAGAGCUAUGCU.

The crRNAs and tracrRNA are purchased from Integrated DNA Technologies, Coralville, IA. Ribonucleoprotein (RNP) complexes are prepared using gRNA (crRNA: tracrRNA) and Cas9 nuclease (Aldevron, Fargo, ND).

The tomato KAS gene (Solyc08g082620.2.1) has the partial genomic sequence of (SEQ ID NO: 974)
CAACCCTTTAATGTCACATTTCTTGTTTGGTCTTGTGAATTTAAGTCTGC

AACTGTCACAAAAATCATACTACTATATTAATGTGTTGCATTTATCGCCA

TTTTTTTAATACTGTTTTCTTGCTTAGCAAATATTACTATACTTGGGCGG

ATTCTCCAAATCCCATGTGCAATTAAAATTACAAACTTTGTTATTTACTC

CATTTTCTTGGATCTCTCTATGACTTGTCTTTTTCTAATTTTCTATATAT

TTACCAACATGTTATGTTGAATTAAAAGAAGAAAAAAAACAAGAAGATTT

AGTTTTTTTATTTTTGTGTGTGTGTTTGAGAAAATGAGTAGTATTAC

TTATTCTAATTTGATATTGAAGAGGA.

Expression of KAS is constitutively increased by inserting an expression enhancing oligonucleotide in the 5' region of the gene. A maize OCS homologue (see Examples 18 encoded by a chemically modified single-stranded DNA with the sequence of SEQ ID NO:918 (Integrated DNA Technologies, Coralville, IA), phosphorylated on the 5' end and containing two phosphorothioate linkages at each terminus (i. e., the two linkages between the most distal three bases on either end of the strand) is designed for insertion at a double-strand break effected between nucleotides at positions 103/104, 168/169 or 259/260 of SEQ ID NO:974 in order to provide constitutively increased expression of KAS. Three BCAT crRNAs are designed to target the nucleotides shown in bold italic in SEQ ID NO: 974 and have the sequences of (SEQ ID NO: 975)
UUUGUAAUUUUAAUUGCACAGUUUUAGAGCUAUGCU, (SEQ ID NO: 976)
UUUAAUUCAACAUAACAUGUGUUUUAGAGCUAUGCU,
and (SEQ ID NO: 977)
AGAAAACAGUAUUAAAAAAAGUUUUAGAGCUAUGCU.

The crRNAs and tracrRNA are purchased from Integrated DNA Technologies, Coralville, IA. Ribonucleoprotein (RNP) complexes are prepared using gRNA (crRNA: tracrRNA) and Cas9 nuclease (Aldevron, Fargo, ND).

In one embodiment, one or more genomic changes are made in the plant's genome during vegetative development; this is useful especially in plants that can be vegetatively propagated (e. g., from cuttings), such as tomato and tobacco. Such plants are conveniently grown in soil or in tissue culture media.

In this example, tomato meristem microinjection and meristem cell preparation are described. The apical or axillary meristem of a young plant is surgically exposed and genome editing reagents are introduced just below the L1 layer, into the L2 layer, of the meristem using a microinjection apparatus. The injected tissue is allowed to recover, and the resulting newly formed tissue is examined for the presence of the intended genomic edits. This cycle can be repeated many times, facilitated by propagating cuttings of the edited plant material from time to time. Modifications to the plant genome can be monitored by one or more molecular assays. Once the intended changes are complete, the plant is permitted to flower, is selfed or crossed, and produces seed. The next generation is examined for the presence and activity of all intended edits.

The genome editing reagents for this work are selected from DNA, RNA, protein, or a combination thereof (such as the ribonucleoproteins described elsewhere in this application). The reagents are delivered using an appropriate microinjection apparatus in a volume of about 2 to about 20 nanoliters per cell. The editing reagents can be delivered alone or as part of a formulation to aid in uptake by the targeted meristematic cells. These reagents can include saponin, pectinase, DMSO, Silwet-77, Tween-20, or any other agent that permeabilizes or otherwise makes penetrable the plant cell wall without compromising the cell's activity or interfering with the activity of the editing reagents.

To introduce editing reagents, the newly formed leaf tissue in the target plant is carefully removed to expose the meristem without damaging it. The stem is gently, but firmly supported to counteract the pressure of the microinjection needle. A dissecting or compound microscope with appropriate optics is used to ensure that the microinjection needle accurately contacts the meristematic cells (specifically, the L2 cell layer, which gives rise to the germline). Once the meristem cells are treated, the stem is marked and the plant allowed to recover for several days. It is possible that more than one meristem per plant can be treated with identical or distinct editing reagents. The recovery period is long enough for the plant to grow 3-5 new leaves from the treated meristem. When sufficient new leaf tissue is present, a small piece of a newly formed leaf is excised for molecular analysis.

Molecular analysis encompasses a variety of assays or tests designed to detect the presence of the intended genomic modifications. For example, mRNA from the targeted gene(s) can be amplified by RT-PCR and sequenced to determine if genomic edits are present. Genomic DNA can be examined by targeted sequence analysis for the presence of the intended genomic modifications. Leaf tissue can be examined for visual or physical evidence (i. e., a detectable phenotype) of an intended genomic modification. The time required for evaluation of genomic modifications allows the plant to further recover from the microinjection and makes it competent for further genomic editing, if necessary.

If more genomic edits are required prior to flowering, tissue segments representing edited material can be vegetatively propagated. Excised plantlets are rooted in fresh soil or tissue culture media prior to the next editing step. Care is taken to insure the propagated plant is actively growing (e. g., displays evidence of robust root growth and new leaf formation) before initiating the next microinjection.

When genomic editing activities are complete, the plants are grown to reproductive maturity. If desired further vegetative propagation can be done to produce multiple clones of the edited plant prior to flowering. This may be desirable to ensure adequate seed production. Plants can be selfed or crossed as appropriate to produce seed. The resulting seeds are planted and the germinated seedlings are tested for the presence of the intended edits.

Example 34

This example describes the modification of two tomato genes to improve NUE and to increase drought resistance.

Increased expression of LeNRT2.3 and mutations in S1PYR1 can improve NUE and increase drought resistance.

The gene modification for increasing the expression of LeNRT2.3 is described in Example 17. The gene modification for generating mutations in S1PYR1 is described in Example 28.

Example 35

This example describes the modification of two tomato genes to make tomatoes with high lycopene content and high sugar content.

Disruption of CYC-B gene and mutations in LIN5 can increase the lycopene content and sugar content in tomato.

The gene modification for disrupting the CYC-B gene is described in Example 13. The gene modification for generating mutations in LIN5 is described in Example 27.

Example 36

This example describes the modification of four tomato genes to make tomatoes with determinate growth, rapid flowering, increased fruit size, and high lycopene content.

Disruption of SP gene, decreased expression of SP5G, disruption of CLV1 gene, and disruption of CYC-B gene can lead to determinate growth, rapid flowering, increased fruit size, and high lycopene content.

The gene modification for disrupting the SP gene is described in Example 12. The gene modification for decreasing the expression of SP5G is described in Example 19. The gene modification for disrupting the CLV1 gene is described in Example 16. The gene modification for disrupting the CYC-B gene is described in Example 13.

Example 37

Nitrogen is the key limiting nutrient required for plant growth. Application of synthetic nitrogen fertilizer to farmland resulted in a dramatic increase in crop yields but also led to serious environmental problems. New solutions are needed to increase yields while maintaining or preferably decreasing fertilizer to maximize the nitrogen use efficiency (NUE) in crops. Several strategies using gene transformation to overexpress nitrate transporter and regulation genes successfully achieved higher crop yields. The hypothesis is to maximize NUE by editing multiple genes simultaneously.

Examples of genes and enzyme families that can be modified to increase NUE are shown in Table 3. To maximize NUE, protoplasts are transfected with combination of RNPs targeting different members in each gene family. QPCR or RNA-Seq are used to evaluate NUE by investigating nitrate responsive genes expression level.

TABLE 3

| Gene family | Member | Gene ID | Change in gene activity | Element inserted |
| --- | --- | --- | --- | --- |
| nitrate transporter | LeNRT1.1 | 101249671 | Increase expression | AtNRE |
| | LeNRT1.2 | 101265846 | Increase expression | AtNRE |
| | LeNRT2.1 | AF092655 | Increase expression | AtNRE |
| | LeNRT2.2 | 101265831 | Increase expression | AtNRE |
| | LeNRT2.3 | 543827 | Increase expression | AtNRE |
| glutamine synthetase | GS1 | 544275 | Increase expression | AtNRE |
| | GS2 | 543998 | Increase expression | AtNRE |
| | GTS1 | 543756 | Increase expression | AtNRE |
| | GS isozyme like | 101248274 | Increase expression | AtNRE |
| alanine aminotransferase | AlaAT1 | Solyc03g123610 | Increase expression | AtNRE |
| | AlaAT2 | 101260239 | Increase expression | AtNRE |
| | AlaAT2-Like | 101246328 | Increase expression | AtNRE |
| ammonium transporter | LeAMT1; 1 | 101265282 | Increase expression | AtNRE |
| | LeAMT1;2 | 544110 | Increase expression | AtNRE |
| | LeAMT1;3 | 543590 | Increase expression | AtNRE |

Example 38

Tomato productivity can be improved in tomato by targeting processes associated with non-photochemical quenching (NPQ). This is a strategy to increase photosynthetic efficiency. Orthologous genes to those targeted in Kromdjik et al. (2016, Science, 354 (6314): 857-61) can be up-regulated by inserting an enhancer element in the promoter proximal region of the tomato orthologous genes for the chloroplastic photosystem II 22 kDa protein (PsbS-Gene ID 101260830, SEQ ID NO: 980), violaxanthin de-epoxidase (VDE-Gene ID 543696, SEQ ID NO:981) and zeoxanthin epoxidase (ZEP-Gene ID 544162, SEQ ID NO: 982). Upregulation of each individual gene in model plants has a low to marginal effect on photosynthetic efficiency (Hubbart et al., 2012, The Plant Journal: For Cell and Molecular Biology, 71 (3): 402-12; Leonelli et al., 2016, The Plant Journal: For Cell and Molecular Biology, 88 (3): 375-86). The combined effect of up-regulating all three genes produces a much larger effect. Kromdjik et al. (2016) demonstrated this in tobacco by inserting transgenes driven by highly active green tissue-preferred promoters. Here we demonstrate how this can be done using gene editing technology.

There is scattered evidence for 'enhancer' elements that function in plants, and may be applicable here (Marand et al., 2017, Plant Gene Regulatory Mechanisms and Networks, 1860 (1): 131-39). Most of the heavily used cis-enhancer elements come from plant pathogens. For example, there are well characterized virus-derived enhancer elements that work well in crops like maize (Davies et al., 2014, BMC Plant Biology, 14 (December): 359) but these are less desirable due to their length (generally 1-200 bp). Technology to scan genomes for putative regulatory elements that are ~20 bp in length is available. Most of the work has been done in *Arabidopsis* (Burgess et al., 2015, Current Opinion in Plant Biology, 27 (October): 141-47) and this remains a largely theoretical area. Here we use the nopaline synthase OCS element (SEQ ID NO:918), Ellis et al., 1987, The EMBO Journal, 6 (11): 3203-8) tq upregulate the three tomato NPQ genes. G-box (5'-/Phos/G*C* CAC GTG CCG CCA CGT GCC GCC ACG TGC CGC CAC GTG* C*C-3', SEQ ID NO:978) and green tissue-specific promoter (GSP, 5'-/Phos/A*A*AATATTTATAAAATATTTATAAAATAT-TTATAAAATATTT*A*T-3', SEQ ID NO:979) can also be used to upregulate the NPQ genes.

An appropriate guide RNA is designed to target Cas9 or its equivalent to one or more sites within 500 bp of each gene's transcription start site. The site-directed endonuclease can be delivered as a ribonucleoprotein (RNP) complex or encoded on plasmid DNA. Synthetic oligonucleotides representing 1-5 copies of the OCS element (Ellis et al. 1987) are co-delivered with the site-specific endonuclease. The design of each guide RNA can be developed and optimized in a tomato protoplast system, using qRT-PCR of mRNA from each target gene to report successful up-regulation. Alternatively, a synthetic promoter for each target gene, linked to a suitable reporter gene like eGFP, can be co-transfected with the site-specific RNPs and enhancer oligonucleotide into protoplasts to evaluate the efficacy of all possible guide RNAs to identify the most effective candidates for deliver to whole plant tissues. The most effective RNPs are used to insert the NPQ technology in tomato.

One of many published methods for introducing the OCS enhancer element into the predetermined target sites of the tomato NPQ genes can used to generate lines with enhanced photosynthetic activity. These include *Agrobacterium*, viral or biolistic-mediated approaches (Senapati, 2016 (doi: 10.9734/ARRB/2016/22300)). The RNPs and OCS element can also be introduced by microinjection.

Tomato tissues that are appropriate for genome editing manipulation include embryogenic callus, exposed shoot apical meristems and 1 DAP embryos. There are many approaches to producing embryogenic callus (for example, Toyoda et al., 1988 (doi:10.1007/BF00269921), Tahir 2010 (doi:10.1007/978-1-61737-988-8_21), Ge et al., 2006 (doi: 10.1007/s00299-005-0100-7), Senapati, 2016 (doi: 10.9734/ARRB/2016/22300)). Shoot apical meristem explants can be prepared using a variety of methods in the art (Sticklen and Oraby, 2005 (doi:10.1079/IVP2004616), Baskaran and Dasgupta, 2012 (doi:10.1007/s13562-011-0078-x), Senapati, 2016 (doi: 10.9734/ARRB/2016/22300)). This work describes how to prepare and nurture material that is adequate for microinjection.

To prepare one day after germination seedlings for microinjection, tomato seed are germinated under ideal conditions in a growth chamber with supplemental lighting for a 16-hour day, day/night temperatures of 25/20° C., and relative humidity between 60-80%. The one day after germination seedlings are identified and prepped essentially as described in Vinoth et al., 2013 (doi: 10.1007/s12010-012-0006-0). Germinated seeds with 2-3 mm meristems are placed on the appropriate solid support medium and oriented for easy access using a microinjection needle.

Microinjection is used to target specific cells in the shoot apical meristem. For example, an injector attached to a Narashige manipulator on a dissecting microscope is adequate for injecting relatively large cells (e.g., the egg/ synergids/zygote and the central cell). For smaller cells, such as those of the embryo or shoot apical meristems, a compound, inverted microscope with an attached Narashige manipulator can be used. Injection pipette diameter and bevel are also important. Use a high-quality pipette puller and beveler to prepare needles with adequate strength, flexibility and pore diameter. These will vary depending on the cargo being delivered to cells. The volume of fluid to be microinjected must be exceedingly small and must be carefully controlled. An Eppendorf Transjector yields consistent results (Laurie et al., 1999).

The genetic cargo can be RNA, DNA, protein or a combination thereof. For example to introduce the NPQ trait the cargo consists of the RNPs targeting the promoter proximal region of the tomato PsBS, VDE and ZEP genes, and the OCS enhancer element. The concentration of each cargo component will vary depending on the nature of the manipulation. Typical cargo volumes can vary from 2-20 nanoliters. After microinjection the treated plant parts are maintained on an appropriate media alone or supplemented with a feeder culture. Plantlets are transferred to fresh media every two weeks and to larger containers as they grow. Plantlets with a well-developed root system are transferred to soil and maintained in high-humidity for 5 days to acclimate. Plants are gradually exposed to the air and cultivated to reproductive maturity.

Several molecular techniques can be used to confirm that the intended edits are present in the treated plants. These include sequence analysis of each target site and qRT-PCR of each target gene. The NPQ trait is confirmed using photosynthesis instrument such as a Ciras 3 or Licor 6400, to compare modified plants to unmodified or wildtype plants. The NPQ trait is expected to increase biomass accumulation relative to wildtype plants.

Example 39

Table 5 provides a list of genes in tomato associated with various traits including abiotic stress resistance, plant architecture, biotic stress resistance, photosynthesis, and resource partitioning. Within each trait, various non-limiting (and often overlapping) sub-categories of traits may be identified, as presented in the Table. For example, "abiotic stress resistance" may be related to or associated with changes in abscisic acid (ABA) signaling, biomass, cold tolerance, drought tolerance, tolerance to high temperatures, tolerance to low temperatures, and/or salt tolerance; the trait "plant architecture" may be related to or may include traits such as biomass, fertilization, flowering time and/or flower architecture, inflorescence architecture, lodging resistance, root architecture, shoot architecture, leaf architecture, and yield; the trait "biotic stress" may include disease resistance, insect resistance, population density stress and/or shading stress; the trait "photosynthesis" can include photosynthesis and respiration traits; the trait "resource partitioning" can include or be related to biomass, seed weight, drydown rate, grain size, nitrogen utilization, oil production and metabolism, protein production and metabolism, provitamin A production and metabolism, seed composition, seed filling (including sugar and nitrogen transport), and starch production and metabolism. By modifying one or more of the associated genes in Table 5, each of these traits may be manipulated singly or in combination to improve the yield, productivity or other desired aspects of a tomato plant comprising the modification(s).

Each of the genes listed in Table 5 may be modified using any of the gene modification methods described herein. In particular, each of the genes may be modified using the targeted modification methods described herein which introduce desired genomic changes at specific locations in the absence of off-target effects. Even more specifically, each of the genes in Table 5 may be modified using the CRISPR targeting methods described herein, either singly or in multiplexed fashion. For example, a single gene in Table 5 could be modified by the introduction of a single mutation (change in residue, insertion of residue(s), or deletion of residue(s)) or by multiple mutations. Another possibility is that a single gene in Table 5 could be modified by the introduction of two or more mutations, including two or more targeted mutations. In addition, or alternatively, two or more genes in Table 5 could be modified (e.g., using the targeted modification techniques described herein) such that the two or more genes each contains one or more modifications.

The various types of modifications that can be introduced into the genes of Table 5 have been described herein. The modifications include both modifications to regulatory regions that affect the expression of the gene product (i.e., the amount of proteins or RNA encoded by the gene) and modifications that affect the sequence or activity of the encoded protein or RNA (in some cases the same modification may affect both the expression level and the activity of the encoded protein or RNA). Modifying genes encoding proteins with the amino acid sequences listed in Table 5 (SEQ ID Nos: 552-893, 983-985), or sequences with at least 95%, 96%, 97%, 98%, or 99% identity to the protein sequences listed in Table 5, may result in proteins with improved or diminished activity. Methods of alignment of sequences for comparison are well known in the art. Two examples of algorithms that are suitable for determining percent sequence identity and sequence similarity are the BLAST and BLAST 2.0 algorithms, which are described in Altschul et al., (1977) *Nuc. Acids Res.* 25:3389-3402; and Altschul et al., (1990) *J. Mol. Biol.* 215:403-410, respectively. Software for performing BLAST analyses is publicly available through the National Center for Biotechnology Information. Optimal alignment of sequences for comparison can also be conducted, e.g., by the local homology algorithm of Smith and Waterman, (1970) *Adv. Appl. Math.* 2:482c, by the homology alignment algorithm of Needleman and Wunsch, (1970) *J. Mol. Biol.* 48:443, by the search for similarity method of Pearson and Lipman, (1988) *Proc. Nat'l. Acad. Sci. USA* 85:2444, by computerized implementations of these algorithms (GAP, BESTFIT, FASTA, and TFASTA in the Wisconsin Genetics Software Package, Genetics Computer Group, 575 Science Dr., Madison, WI), or by manual alignment and visual inspection (see, e.g., Brent et al., (2003) *Current Protocols in Molecular Biology*).

In some cases, targeted modifications may result in proteins with no activity (e.g., the introduction of a stop codon may result in a functionless protein) or a protein with a new activity or feature. Similarly, the sequences of the miRNAs listed in Table 5 may also be modified to increase, decrease or reduce their activity.

In addition to modifications to the encoded proteins or miRNAs, each of the gene sequences listed in Table 5 (e.g., the gene sequences of SEQ IDs 210-551 and 980-982) may also be modified, individually or in combination with one or more other modifications, to alter the expression of the encoded protein or RNA, or to alter the stability of the RNA encoding the corresponding protein sequence. For example, regulatory sequences affecting transcription of any of the genes listed in Table 5, including primer sequences and transcription factor binding sequences, can be modified, or introduced into, any of the gene sequences listed in Table 5 using the methods described herein. The modifications can effect increases in transcription levels, decreases in transcription levels, and/or changes in the timing of transcription of the genes under control of the modified regulatory regions. Targeted epigenetic modifications affecting gene expression may also be introduced.

One skilled in the art will be able to identify regulatory regions (e.g., regulatory regions in the gene sequences provided in Table 5) using techniques described in the literature, e.g., Bartlett A. et al, "Mapping genome-wide transcription-factor binding sites using DAP-seq.", *Nat Protoc*. (2017) August; 12(8):1659-1672; O'Malley R. C. et al, "Cistrome and Epicistrome Features Shape the Regulatory DNA Landscape", *Cell* (2016) Sep. 8; 166(6):1598; He Y et al, "Improved regulatory element prediction based on tissue-specific local epigenomic signatures", *Proc Natl Acad Sci USA*, (2017) Feb. 28; 114(9):E1633-E1640; Zefu Lu et al, "Combining ATAC-seq with nuclei sorting for discovery of cis-regulatory regions in plant genomes", *Nucleic Acids Research*, (2017) V45(6); Rurika Oka et al, "Genome-wide mapping of transcriptional enhancer candidates using DNA and chromatin features in maize", *Genome Biology* (2017) 18:137. In addition, Table 4, provided herein, lists sequences which may be inserted into or otherwise created in the genomic sequences of Table 5 for the purpose of regulating gene expression and/or transcript stability.

The stability of transcribed RNA encoded by the genes in Table 5 (in addition to other genes), can be increased or decreased by the targeted insertion or creation of the transcript stabilizing or destabilizing sequences provided in Table 4 (e.g., SEQ ID Nos. 198-200 and 202). In addition, Table 5 includes miRNAs whose expression can be used to regulate the stability of transcripts comprising the corresponding recognition sites. Additional miRNAs, miRNA precursors and miRNA recognition site sequences that can be used to regulate transcript stability and gene expression in the context of the methods described herein may be found in, e.g., U.S. Pat. No. 9,192,112 (e.g., Table 2), U.S. Pat. Nos. 8,946,511 and 9,040,774, the disclosures of each of which are incorporated by reference herein.

Any of the above regulatory modifications may be combined to regulate a single gene, or multiple genes, or they may be combined with the non-regulatory modifications discussed above to regulate the activity of a single modified gene, or multiple modified genes. The genetic modifications or gene regulatory changes discussed above may affect distinct traits in the tomato cell or plant, or they make affect the same trait. The resulting effects of the described modifications on a trait or trait may be additive or synergistic. Modifications to the tomato genes listed in Table 5 may be combined with modifications to other sequences in the tomato genome for the purpose of improving one or more tomato traits. The tomato sequences of Table 5 may also be modified for the purpose of tracking the expression or localizing the expression or activity of the listed genes and gene products.

TABLE 4

| Type of regulation | Name of element | Sequence | SEQ ID |
|---|---|---|---|
| regulatory control by TF | ABFs binding site motif | CACGTGGC | SEQ ID NO: 19 |
| regulatory control by TF | ABRE binding site motif | (C/T)ACGTGGC | SEQ ID NO: 20 |
| regulatory control by TF | ABRE-like binding site motif | (C/G/T)ACGTG(G/T)(A/C) | SEQ ID NO: 21 |
| regulatory control by TF | ACE promoter motif | GACACGTAGA | SEQ ID NO: 22 |
| regulatory control by TF | AG binding site motif | TT(A/G/T)CC(A/T)(A/T)(A/T)(A/T)(A/T)(A/T)GG(A/C/T) | SEQ ID NO: 23 |
| regulatory control by TF | AG binding site in AP3 | CCATTTTTAGT | SEQ ID NO: 24 |
| regulatory control by TF | AG binding site in SUP | CCATTTTTGG | SEQ ID NO: 25 |
| regulatory control by TF | AGL1 binding site motif | NTT(A/G/T)CC(A/T)(A/T)(A/T)(A/T)NNGG(A/T)AAN | SEQ ID NO: 26 |
| regulatory control by TF | AGL2 binding site motif | NN(A/T)NCCA(A/T)(A/T)(A/T)(A/T)T(A/G)G(A/T)(A/T)AN | SEQ ID NO: 27 |
| regulatory control by TF | AGL3 binding site motif | TT(A/T)C(C/T)A(A/T)(A/T)(A/T)(A/T)T(A/G)G(A/T)AA | SEQ ID NO: 28 |
| regulatory control by TF | AP1 binding site in AP3 | CCATTTTTAG | SEQ ID NO: 29 |
| regulatory control by TF | AP1 binding site in SUP | CCATTTTTGG | SEQ ID NO: 30 |
| regulatory control by TF | ARF binding site motif | TGTCTC | SEQ ID NO: 31 |
| regulatory control by TF | ARF1 binding site motif | TGTCTC | SEQ ID NO: 32 |
| regulatory control by TF | ATHB1 binding site motif | CAAT(A/T)ATTG | SEQ ID NO: 33 |
| regulatory control by TF | ATHB2 binding site motif | CAAT(C/G)ATTG | SEQ ID NO: 34 |
| regulatory control by TF | ATHB5 binding site motif | CAATNATTG | SEQ ID NO: 35 |
| regulatory control by TF | ATHB6 binding site motif | CAATTATTA | SEQ ID NO: 36 |
| regulatory control by TF | AtMYB2 binding site in RD22 | CTAACCA | SEQ ID NO: 37 |
| regulatory control by TF | AtMYC2 binding site in RD22 | CACATG | SEQ ID NO: 38 |
| regulatory control by TF | Box II promoter motif | GGTTAA | SEQ ID NO: 39 |
| regulatory control by TF | CArG promoter motif | CC(A/T)(A/T)(A/T)(A/T)(A/T)(A/T)GG | SEQ ID NO: 40 |
| regulatory control by TF | CArG1 motif in AP3 | GTTTACATAAATGGAAAA | SEQ ID NO: 41 |
| regulatory control by TF | CArG2 motif in AP3 | CTTACCTTTCATGGATTA | SEQ ID NO: 42 |

TABLE 4-continued

| Type of regulation | Name of element | Sequence | SEQ ID |
|---|---|---|---|
| regulatory control by TF | CArG3 motif in AP3 | CTTTCCATTTTTAGTAAC | SEQ ID NO: 43 |
| regulatory control by TF | CBF1 binding site in cor15a | TGGCCGAC | SEQ ID NO: 44 |
| regulatory control by TF | CBF2 binding site motif | CCACGTGG | SEQ ID NO: 45 |
| regulatory control by TF | CCA1 binding site motif | AA(A/C)AATCT | SEQ ID NO: 46 |
| regulatory control by TF | CCA1 motif1 binding site in CAB1 | AAACAATCTA | SEQ ID NO: 47 |
| regulatory control by TF | CCA1 motif2 binding site in CAB1 | AAAAAAAATCTATGA | SEQ ID NO: 48 |
| regulatory control by TF | DPBF1&2 binding site motif | ACACNNG | SEQ ID NO: 49 |
| regulatory control by TF | DRE promoter motif | TACCGACAT | SEQ ID NO: 50 |
| regulatory control by TF | DREB1&2 binding site in rd29a | TACCGACAT | SEQ ID NO: 51 |
| regulatory control by TF | DRE-like promoter motif | (A/G/T)(A/G)CCGACN(A/T) | SEQ ID NO: 52 |
| regulatory control by TF | E2F binding site motif | TTTCCCGC | SEQ ID NO: 53 |
| regulatory control by TF | E2F/DP binding site in AtCDC6 | TTTCCCGC | SEQ ID NO: 54 |
| regulatory control by TF | E2F-varient binding site motif | TCTCCCGCC | SEQ ID NO: 55 |
| regulatory control by TF | EIL1 binding site in ERF1 | TTCAAGGGGCATGTATCTTGAA | SEQ ID NO: 56 |
| regulatory control by TF | EIL2 binding site in ERF1 | TTCAAGGGGCATGTATCTTGAA | SEQ ID NO: 57 |
| regulatory control by TF | EIL3 binding site in ERF1 | TTCAAGGGGCATGTATCTTGAA | SEQ ID NO: 58 |
| regulatory control by TF | EIN3 binding site in ERF1 | GGATTCAAGGGGCATGTATCTTGAATCC | SEQ ID NO: 59 |
| regulatory control by TF | ERE promoter motif | TAAGAGCCGCC | SEQ ID NO: 60 |
| regulatory control by TF | ERF1 binding site in AtCHI-B | GCCGCC | SEQ ID NO: 61 |
| regulatory control by TF | EveningElement promoter motif | AAAATATCT | SEQ ID NO: 62 |
| regulatory control by TF | GATA promoter motif | (A/T)GATA(G/A) | SEQ ID NO: 63 |
| regulatory control by TF | GBF1/2/3 binding site in ADH1 | CCACGTGG | SEQ ID NO: 64 |
| regulatory control by TF | G-box promoter motif | CACGTG | SEQ ID NO: 65 |
| regulatory control by TF | GCC-box promoter motif | GCCGCC | SEQ ID NO: 66 |
| regulatory control by TF | GT promoter motif | TGTGTGGTTAATATG | SEQ ID NO: 67 |

TABLE 4-continued

| Type of regulation | Name of element | Sequence | SEQ ID |
|---|---|---|---|
| regulatory control by TF | Hexamer promoter motif | CCGTCG | SEQ ID NO: 68 |
| regulatory control by TF | HSEs binding site motif | AGAANNTTCT | SEQ ID NO: 69 |
| regulatory control by TF | Ibox promoter motif | GATAAG | SEQ ID NO: 70 |
| regulatory control by TF | JASE1 motif in OPR1 | CGTCAATGAA | SEQ ID NO: 71 |
| regulatory control by TF | JASE2 motif in OPR2 | CATACGTCGTCAA | SEQ ID NO: 72 |
| regulatory control by TF | L1-box promoter motif | TAAATG(C/T)A | SEQ ID NO: 73 |
| regulatory control by TF | LS5 promoter motif | ACGTCATAGA | SEQ ID NO: 74 |
| regulatory control by TF | LS7 promoter motif | TCTACGTCAC | SEQ ID NO: 75 |
| regulatory control by TF | LTRE promoter motif | ACCGACA | SEQ ID NO: 76 |
| regulatory control by TF | MRE motif in CHS | TCTAACCTACCA | SEQ ID NO: 77 |
| regulatory control by TF | MYB binding site promoter | (A/C)ACC(A/T)A(A/C)C | SEQ ID NO: 78 |
| regulatory control by TF | MYB1 binding site motif | (A/C)TCC(A/T)ACC | SEQ ID NO: 79 |
| regulatory control by TF | MYB2 binding site motif | TAACT(G/C)GTT | SEQ ID NO: 80 |
| regulatory control by TF | MYB3 binding site motif | TAACTAAC | SEQ ID NO: 81 |
| regulatory control by TF | MYB4 binding site motif | A(A/C)C(A/T)A(A/C)C | SEQ ID NO: 82 |
| regulatory control by TF | Nonamer promoter motif | AGATCGACG | SEQ ID NO: 83 |
| regulatory control by TF | OBF4,5 binding site in GST6 | ATCTTATGTCATTGATGACGACCTCC | SEQ ID NO: 84 |
| regulatory control by TF | OBP-1,4,5 binding site in GST6 | TACACTTTTGG | SEQ ID NO: 85 |
| regulatory control by TF | OCS promoter motif | TGACG(C/T)AAG(C/G)(A/G)(A/C)T(G/T)ACG(C/T)(A/C)(A/C) | SEQ ID NO: 86 |
| regulatory control by TF | octamer promoter motif | CGCGGATC | SEQ ID NO: 87 |
| regulatory control by TF | PI promoter motif | GTGATCAC | SEQ ID NO: 88 |
| regulatory control by TF | PII promoter motif | TTGGTTTTGATCAAAACCAA | SEQ ID NO: 89 |
| regulatory control by TF | PRHA binding site in PAL1 | TAATTGACTCAATTA | SEQ ID NO: 90 |
| regulatory control by TF | RAV1-A binding site motif | CAACA | SEQ ID NO: 91 |
| regulatory control by TF | RAV1-B binding site motif | CACCTG | SEQ ID NO: 92 |

TABLE 4-continued

| Type of regulation | Name of element | Sequence | SEQ ID |
|---|---|---|---|
| regulatory control by TF | RY-repeat promoter motif | CATGCATG | SEQ ID NO: 93 |
| regulatory control by TF | SBP-box promoter motif | TNCGTACAA | SEQ ID NO: 94 |
| regulatory control by TF | T-box promoter motif | ACTTTG | SEQ ID NO: 95 |
| regulatory control by TF | TEF-box promoter motif | AGGGGCATAATGGTAA | SEQ ID NO: 96 |
| regulatory control by TF | TELO-box promoter motif | AAACCCTAA | SEQ ID NO: 97 |
| regulatory control by TF | TGA1 binding site motif | TGACGTGG | SEQ ID NO: 98 |
| regulatory control by TF | W-box promoter motif | TTGAC | SEQ ID NO: 99 |
| regulatory control by TF | Z-box promoter motif | ATACGTGT | SEQ ID NO: 100 |
| regulatory control by TF | AG binding site in SPL/NOZ | AAAACAGAATAGGAAA | SEQ ID NO: 101 |
| regulatory control by TF | Bellringer/ replumless/ pennywise binding site IN AG | AAATTAAA | SEQ ID NO: 102 |
| regulatory control by TF | Bellringer/ replumless/ pennywise binding site 2 in AG | AAATTAGT | SEQ ID NO: 103 |
| regulatory control by TF | Bellringer/ replumless/ pennywise binding site 3 in AG | ACTAATTT | SEQ ID NO: 104 |
| regulatory control by TF | AGL15 binding site in AtGA2ox6 | CCAATTTAATGG | SEQ ID NO: 105 |
| regulatory control by TF | ATB2/AtbZIP53/ AtbZIP44/ GBF5 binding site in ProDH | ACTCAT | SEQ ID NO: 106 |
| regulatory control by TF | LFY binding site in AP3 | CTTAAACCCTAGGGGTAAT | SEQ ID NO: 107 |
| regulatory control by TF | SORLREP1 | TT(A/T)TACTAGT | SEQ ID NO: 108 |
| regulatory control by TF | SORLREP2 | ATAAAACGT | SEQ ID NO: 109 |
| regulatory control by TF | SORLREP3 | TGTATATAT | SEQ ID NO: 110 |
| regulatory control by TF | SORLREP4 | CTCCTAATT | SEQ ID NO: 111 |
| regulatory control by TF | SORLREP5 | TTGCATGACT | SEQ ID NO: 112 |
| regulatory control by TF | SORLIP1 | AGCCAC | SEQ ID NO: 113 |
| regulatory control by TF | SORLIP2 | GGGCC | SEQ ID NO: 114 |
| regulatory control by TF | SORLIP3 | CTCAAGTGA | SEQ ID NO: 115 |

TABLE 4-continued

| Type of regulation | Name of element | Sequence | SEQ ID |
|---|---|---|---|
| regulatory control by TF | SORLIP4 | GTATGATGG | SEQ ID NO: 116 |
| regulatory control by TF | SORLIP5 | GAGTGAG | SEQ ID NO: 117 |
| regulatory control by TF | ABFs binding site motif | CACGTGGC | SEQ ID NO: 118 |
| down | NdeI restriction site | GTTTAATTGAGTTGTCATATGTTAATAACGGTAT | SEQ ID NO: 119 |
| down | NdeI restriction site | ATACCGTTATTAACATATGACAACTCAATTAAAC | SEQ ID NO: 120 |
| up (auxin responsive) | 3xDR5 auxin-response element | CCGACAAAAGGCCGACAAAAGGCCGACAAAAGGT | SEQ ID NO: 121 |
| up (auxin responsive) | 3xDR5 auxin-response element | ACCTTTTGTCGGCCTTTTGTCGGCCTTTTGTCGG | SEQ ID NO: 122 |
| up (auxin responsive) | 6xDR5 auxin-responsive element | GCCGACAAAAGGCCGACAAAAGGCCGACAAAAGGC CGACAAAAGGCCGACAAAAGGT | SEQ ID NO: 123 |
| up (auxin responsive) | 6xDR5 auxin-responsive element | ACCTTTTGTCGGCCTTTTGTCGGCCTTTTGTCGGC CTTTTGTCGGCCTTTTGTCGG | SEQ ID NO: 124 |
| up (auxin responsive) | 9xDR5 auxin-responsive element | CCGACAAAAGGCCGACAAAAGGCCGACAAAAGGCC GACAAAAGGCCGACAAAAGGCCGACAAAAGGCCGA CAAAAGGT | SEQ ID NO: 125 |
| up (auxin responsive) | 9xDR5 auxin-responsive element | ACCTTTTGTCGGCCTTTTGTCGGCCTTTTGTCGGC CTTTTGTCGGCCTTTTGTCGGCCTTTTGTCGGCCT TTTGTCGG | SEQ ID NO: 126 |
| Cre recombinase recognition site | LoxP (wild-type 1) | ATAACTTCGTATAGCATACATTATACGAAGTTAT | SEQ ID NO: 127 |
| Cre recombinase recognition site | LoxP (wild-type 2) | ATAACTTCGTATAATGTATGCTATACGAAGTTAT | SEQ ID NO: 128 |
| Cre recombinase recognition site | Canonical LoxP | ATAACTTCGTATANNNTANNNTATACGAAGTTAT | SEQ ID NO: 129 |
| Cre recombinase recognition site | Lox 511 | ATAACTTCGTATAATGTATaCTATACGAAGTTAT | SEQ ID NO: 130 |
| Cre recombinase recognition site | Lox 5171 | ATAACTTCGTATAATGTgTaCTATACGAAGTTAT | SEQ ID NO: 131 |
| Cre recombinase recognition site | Lox 2272 | ATAACTTCGTATAAaGTATcCTATACGAAGTTAT | SEQ ID NO: 132 |
| Cre recombinase recognition site | M2 | ATAACTTCGTATAAgaaAccaTATACGAAGTTAT | SEQ ID NO: 133 |
| Cre recombinase recognition site | M3 | ATAACTTCGTATAtaaTACCATATACGAAGTTAT | SEQ ID NO: 134 |
| Cre recombinase recognition site | M7 | ATAACTTCGTATAAgaTAGAATATACGAAGTTAT | SEQ ID NO: 135 |
| Cre recombinase recognition site | M11 | ATAACTTCGTATAaGATAgaaTATACGAAGTTAT | SEQ ID NO: 136 |
| Cre recombinase recognition site | Lox 71 | taccgTTCGTATANNNTANNNTATACGAAGTTAT | SEQ ID NO: 137 |
| Cre recombinase recognition site | Lox 66 | ATAACTTCGTATANNNTANNNTATACGAAcggta | SEQ ID NO: 138 |
| maize ovule/early kernel transcript down-regulation | miR156j recognition site | GTGCTCTCTCTCTTCTGTCA | SEQ ID NO: 139 |

TABLE 4-continued

| Type of regulation | Name of element | Sequence | SEQ ID |
|---|---|---|---|
| maize ovule/early kernel transcript down-regulation | miR156j recognition site | CTGCTCTCTCTCTTCTGTCA | SEQ ID NO: 140 |
| maize ovule/early kernel transcript down-regulation | miR156j recognition site | TTGCTTACTCTCTTCTGTCA | SEQ ID NO: 141 |
| maize ovule/early kernel transcript down-regulation | miR156j recognition site | CCGCTCTCTCTCTTCTGTCA | SEQ ID NO: 142 |
| maize ovule/early kernel transcript down-regulation | miR159c recognition site | TGGAGCTCCCTTCATTCCAAT | SEQ ID NO: 143 |
| maize ovule/early kernel transcript down-regulation | miR159c recognition site | TCGAGTTCCCTTCATTCCAAT | SEQ ID NO: 144 |
| maize ovule/early kernel transcript down-regulation | miR159c recognition site | ATGAGCTCTCTTCAAACCAAA | SEQ ID NO: 145 |
| maize ovule/early kernel transcript down-regulation | miR159c recognition site | TGGAGCTCCCTTCATTCCAAG | SEQ ID NO: 146 |
| maize ovule/early kernel transcript down-regulation | miR159c recognition site | TAGAGCTTCCTTCAAACCAAA | SEQ ID NO: 147 |
| maize ovule/early kernel transcript down-regulation | miR159c recognition site | TGGAGCTCCATTCGATCCAAA | SEQ ID NO: 148 |
| maize ovule/early kernel transcript down-regulation | miR159c recognition site | AGCAGCTCCCTTCAAACCAAA | SEQ ID NO: 149 |
| maize ovule/early kernel transcript down-regulation | miR159c recognition site | CAGAGCTCCCTTCACTCCAAT | SEQ ID NO: 150 |
| maize ovule/early kernel transcript down-regulation | miR159c recognition site | TGGAGCTCCCTTCACTCCAAT | SEQ ID NO: 151 |
| maize ovule/early kernel transcript down-regulation | miR159c recognition site | TGGAGCTCCCTTCACTCCAAG | SEQ ID NO: 152 |
| maize ovule/early kernel transcript down-regulation | miR159c recognition site | TGGAGCTCCCTTTAATCCAAT | SEQ ID NO: 153 |
| maize embryo transcript down-regulation | miR166b recognition site | TTGGGATGAAGCCTGGTCCGG | SEQ ID NO: 154 |
| maize embryo transcript down-regulation | miR166b recognition site | CTGGGATGAAGCCTGGTCCGG | SEQ ID NO: 155 |
| maize embryo transcript down-regulation | miR166b recognition site | CTGGAATGAAGCCTGGTCCGG | SEQ ID NO: 156 |
| maize embryo transcript down-regulation | miR166b recognition site | CGGGATGAAGCCTGGTCCGG | SEQ ID NO: 157 |
| maize endosperm transcript down-regulation | miR167g recognition site | GAGATCAGGCTGGCAGCTTGT | SEQ ID NO: 158 |

TABLE 4-continued

| Type of regulation | Name of element | Sequence | SEQ ID |
|---|---|---|---|
| maize endosperm transcript down-regulation | miR167g recognition site | TAGATCAGGCTGGCAGCTTGT | SEQ ID NO: 159 |
| maize endosperm transcript down-regulation | miR167g recognition site | AAGATCAGGCTGGCAGCTTGT | SEQ ID NO: 160 |
| maize pollen transcript down-regulation | miR156i recognition site | GTGCTCTCTCTCTTCTGTCA | SEQ ID NO: 161 |
| maize pollen transcript down-regulation | miR156i recognition site | CTGCTCTCTCTCTTCTGTCA | SEQ ID NO: 162 |
| maize pollen transcript down-regulation | miR156i recognition site | TTGCTTACTCTCTTCTGTCA | SEQ ID NO: 163 |
| maize pollen transcript down-regulation | miR156i recognition site | CCGCTCTCTCTCTTCTGTCA | SEQ ID NO: 164 |
| maize pollen transcript down-regulation | mir160b-like recognition site | TGGCATGCAGGGAGCCAGGCA | SEQ ID NO: 165 |
| maize pollen transcript down-regulation | mir160b-like recognition site | AGGAATACAGGGAGCCAGGCA | SEQ ID NO: 166 |
| maize pollen transcript down-regulation | mir160b-like recognition site | GGGTTTACAGGGAGCCAGGCA | SEQ ID NO: 167 |
| maize pollen transcript down-regulation | mir160b-like recognition site | AGGCATACAGGGAGCCAGGCA | SEQ ID NO: 168 |
| maize pollen transcript down-regulation | miR393a recognition site | AAACAATGCGATCCCTTTGGA | SEQ ID NO: 169 |
| maize pollen transcript down-regulation | miR393a recognition site | AGACCATGCGATCCCTTTGGA | SEQ ID NO: 170 |
| maize pollen transcript down-regulation | miR393a recognition site | GGTCAGAGCGATCCCTTTGGC | SEQ ID NO: 171 |
| maize pollen transcript down-regulation | miR393a recognition site | AGACAATGCGATCCCTTTGGA | SEQ ID NO: 172 |
| maize pollen transcript down-regulation | miR396a recognition site | TCGTTCAAGAAAGCCTGTGGAA | SEQ ID NO: 173 |
| maize pollen transcript down-regulation | miR396a recognition site | CGTTCAAGAAAGCCTGTGGAA | SEQ ID NO: 174 |
| maize pollen transcript down-regulation | miR396a recognition site | TCGTTCAAGAAAGCATGTGGAA | SEQ ID NO: 175 |
| maize pollen transcript down-regulation | miR396a recognition site | ACGTTCAAGAAAGCTTGTGGAA | SEQ ID NO: 176 |
| maize pollen transcript down-regulation | miR396a recognition site | CGTTCAAGAAAGCCTGTGGAA | SEQ ID NO: 177 |

TABLE 4-continued

| Type of regulation | Name of element | Sequence | SEQ ID |
|---|---|---|---|
| maize male tissue transcript down-regulation | male tissue-specific siRNA element | GGACAACAAGCACCTTCTTGCCTTGCAAGGCCTCCCTTCCCTATGG<br>TAGCCACTTGAGTGGATGACTTCACCTTAAAGCTATTGATTCCCTA<br>AGTGCCAGACATAATAGGCTATACATTCTCTCTGGTGGCAACAATG<br>AGCCATTTTGGTTGGTGTGGTAGTCTATTATTGAGTTTTTTTTGGC<br>ACCGTACTCCCATGGAGAGTAGAAGACAAACTCTTCACCGTTGTAG<br>TCGTTGATGGTATTGGTGGTGACGACATCCTTGGTGTGCATGCACT<br>GGTGAGTCACTGTTGTACTCGGCG | SEQ ID NO: 178 |
| maize male tissue transcript down-regulation | male tissue-specific siRNA element | GGACAACAAGCACCTTCTTGCCTTGCAAGGCCTCCCTTCCCTATGG<br>TAGCCACTTGAGTGGATGACTTCACCTTAAAGCTATCGATTCCCTA<br>AGTGCCAGACAT | SEQ ID NO: 179 |
| maize male tissue transcript down-regulation | male tissue-specific siRNA element | CTCTTCACCGTTGTAGTCGTTGATGGTATTGGTGGTGACGACATCC<br>TTGGTGTGCATGCACTGGTGAGTCACTGTTGTAC | SEQ ID NO: 180 |
| maize male tissue transcript down-regulation | male tissue-specific siRNA element | GGACAACAAGCACCTTCTTGCCTTGCAAGGCCTCCCTTCCCTATGG<br>TAGCCACTTGAGTGGATGACTTCACCTTAAAGCTATCGATTCCCTA<br>AGTGCCAGACATCTCTTCACCGTTGTAGTCGTTGATGGTATTGGTG<br>GTGACGACATCCTTGGTGTGCATGCACTGGTGAGTCACTGTTGTAC | SEQ ID NO: 181 |
| maize male tissue transcript down-regulation | male tissue-specific siRNA element | CTCTTCACCGTTGTAGTCGTTGATGGTATTGGTGGTGACGACATCC<br>TTGGTGTGCATGCACTGGTGAGTCACTGTTGTACGGACAACAAGCA<br>CCTTCTTGCCTTGCAAGGCCTCCCTTCCCTATGGTAGCCACTTGAG<br>TGGATGACTTCACCTTAAAGCTATCGATTCCCTAAGTGCCAGACAT | SEQ ID NO: 182 |
| up (auxin reponsive; constitutive) | ocs enhancer (Agrobacterium sp.) | ACGTAAGCGCTTACGT | SEQ ID NO: 183 |
| up (auxin reponsive; constitutive) | 12-nt ocs orthologue (Zea mays) | GTAAGCGCTTAC | SEQ ID NO: 184 |
| up (nitrogen responsive) | AtNRE | AAGAGATGAGCTCTTGAGCAATGTAAAGGGTCAAGTIGTTTCT | SEQ ID NO: 185 |
| up (nitrogen responsive) | AtNRE | AGAAACAACTTGACCCTTTACATTGCTCAAGAGCTCATCTCTT | SEQ ID NO: 186 |
| up (auxin responsive) | 3xDR5 auxin-response element; RNA strand of RNA/DNA hybid | ACCUUUUGUCGGCCUUUUGUCGGCCUUUUGUCGG | SEQ ID NO: 187 |
| up (auxin responsive) | 3xDR5 auxin-response element; sticky-ended | TCGGTCCGACAAAAGGCCGACAAAAGGCGGACAAAAGG | SEQ ID NO: 188 |
| up (auxin responsive) | 3xDR5 auxin-response element; sticky-ended | ACCGACCTTTTGTCGGCCTTTTGTCGGCCTTTTGTCGG | SEQ ID NO: 189 |
| down or up (MAMP-responsive) | OsTBF1 uORF2 | ATGGGAGTAGAGGCGGGCGGCGGCTGCGGTGGGAGGCGGTAGTCA<br>CCGGATTCTACGTCTGGGGCTGGGAGTTCCTCACCGCCCTCCTGCT<br>CTTCTCGGCCACCACCTCCTACTAG | SEQ ID NO: 190 |
| down or up (MAMP-responsive) | synthetic R-motif | AAAAAAAAAAAAAA | SEQ ID NO: 191 |
| down or up (MAMP-responsive) | AtTBF1 R-motif | CACATACACACAAAAATAAAAAGA | SEQ ID NO: 192 |
| decreases upregulation | insulator | GAATATATATATATTC | SEQ ID NO: 193 |
| sequence modification | ZmEPSPS exon 1 with two point mutations and heterospecific lox sites | GTGAACAACCTTATGAAATTTGGGCGCATAACTTCGTATAGCATAC<br>ATTATACGAAGTTATAAAGAACTCGCCCTCAAGGGTTGATCTTATG<br>CCATCGTCATGATAAACAGTGGAGCACGGACGATCCTTTACGTTGT<br>TTTTAACAAACTTTGTCAGAAAACTAGCATCATTAACTTCTTAATG<br>ACGATTTCACAACAAAAAAGGTAACCTCGCTACTAACATAACAAA<br>ATACTTGTTGCTTATTAATTATATGTTTTTTAATCTTTGATCAGGG<br>GACAACAGTGGTTGATAACCTGTTGAACAGTGAGGATGTCCACTAC<br>ATGCTCGGGGCCTTGAGGACTCTTGGTCTCTCTGTCGAAGCGGACA<br>AAGCTGCCAAAAGAGCTGTAGTTGTTGGCTGTGGTGGAAAGTTCCC | SEQ ID NO: 194 |

TABLE 4-continued

| Type of regulation | Name of element | Sequence | SEQ ID |
|---|---|---|---|
| | | AGTTGAGGATTCTAAAGAGGAAGTGCAGCTCTTCTTGGGGAATGCT GGAATTGCAATGCGGGCATTGACAGCAGCTGTTACTGCTGCTGGTG GAAATGCAACGTATGTTTCCTCTCTTTCTCTCTACAATACTTGCAT AACTTCGTATAAAGTATCCTATACGAAGTTATTGGAGTTAGTATGA AACCCATGGGTATGTCTAGT | |
| decreases upregulation | miniature inverted-repeat transposable element ("MITE") | TACTCCCTCCGTTTCTTTTTATTAGTCGCTGGATAGTGCAATTTTG CACTATCCAGCGACTAATAAAAAGAAACGGAGGGAGTA | SEQ ID NO: 195 |
| decreases upregulation | miniature inverted-repeat transposable element ("MITE") | TACTCCCTCCGTTTCTTTTTATTAGTCGCTGGATAGTGCAAAATTG CACTATCCAGCGACTAATAAAAAGAAACGGAGGGAGTA | SEQ ID NO: 196 |
| up (constitutive) | G-box | ACACGTGACACGTGACACGTGACACGTG | SEQ ID NO: 197 |
| decreased transcript stability | mRNA destabilizing element (mammalian) | TTATTTATTTTATTTATTTTATTTATTTTATTTATT | SEQ ID NO: 198 |
| decreased transcript stability | mRNA destabilizing element (Arabidopsis thaliana) | AATTTTAATTTTAATTTTAATTTTAATTTTAATTTT | SEQ ID NO: 199 |
| increased transcript stability | mRNA stabilizing element | TCTCTTTCTCTTTCTCTTTCTCTTTCTCTT | SEQ ID NO: 200 |
| down | SHAT1-repressor | ATTAAAAAAATAAATAAGATATTATTAAAAAAATAAATAAGATATT ATTAAAAAAATAAATAAGATATTATTAAAAAAATAAATAAGATATT | SEQ ID NO: 201 |
| decreased transcript stability | SAUR mRNA destabilizing element | AGATCTAGGAGACTGACATAGATTGGAGGAGACATTTTGTATAATA AGATCTAGGAGACTGACATAGATTGGAGGAGACATTTTGTATAATA | SEQ ID NO: 202 |
| down by recruiting transcription factors interacting with PRC2 | CTCC | CTCC(T/A/G)CC(G/T/A) | SEQ ID NO: 203 |
| down by recruiting transcription factors interacting with PRC2 | CCG | (C/T/A)(G/T)C(C/A)(G/A)(C/A)C(G/T)(C/A) | SEQ ID NO: 204 |
| down by recruiting transcription factors interacting with PRC2 | G-box | (C/G)ACGTGGNN(G/A/C)(T/A) | SEQ ID NO: 205 |
| down by recruiting transcription factors interacting with PRC2 | GA repeat | A(G/A)A(G/A)AGA(G/A)(A/G) | SEQ ID NO: 206 |
| down by recruiting transcription factors interacting with PRC2 | AC-rich | CA(A/T/C)CA(C/A)CA(A/C/T) | SEQ ID NO: 207 |
| down by recruiting transcription factors interacting with PRC2 | Telobox | (A/G)AACCC(T/A)A(A/G) | SEQ ID NO: 208 |

TABLE 4-continued

| Type of regulation | Name of element | Sequence | SEQ ID |
|---|---|---|---|
| up (Pi starvation response) | P1BS | GNATATNC | SEQ ID NO: 209 |
| Up | OCS | GTAAGCGCTTAC | SEQ ID NO: 918 |
| Down | Silencer | GAATATATATATATTC | SEQ ID NO: 923 |
| Down | mRNA destablizing element | AATTTTAATTTTAATTTTAATTTTAATTTTAATTTT | SEQ ID NO: 935 |
| Up | Gbox | GCCACGTGCCGCCACGTGCCGCCACGTGCCGCCACGTGCC | SEQ ID NO: 978 |
| Up | Green tissue-specific promoter (GSP) | AAAATATTTATAAAATATTTATAAAATATTTATAAAATATTTAT | SEQ ID NO: 979 |

TABLE 5

| Trait | Gene(s) | Gene ID | Gene Product | Expression Change | Gene SEQ ID | Protein SEQ ID |
|---|---|---|---|---|---|---|
| Abiotic stress | AdBiL | 101256712 | protein | Increase | SEQ ID NO: 210 | SEQ ID NO: 552 |
| Abiotic stress | Adi3 | 543952 | protein | Decrease | SEQ ID NO: 211 | SEQ ID NO: 553 |
| Abiotic stress | AIM1 | 100271699 | protein | Increase | SEQ ID NO: 212 | SEQ ID NO: 554 |
| Abiotic stress | AN2 | 101247276 | protein | Increase | SEQ ID NO: 213 | SEQ ID NO: 555 |
| Abiotic stress | AO | 778230 | protein | Decrease | SEQ ID NO: 214 | SEQ ID NO: 556 |
| Abiotic stress | aquaporin | 101268623 | protein | Increase | SEQ ID NO: 215 | SEQ ID NO: 557 |
| Abiotic stress | AREB | 544204 | protein | Increase | SEQ ID NO: 216 | SEQ ID NO: 558 |
| Abiotic stress | ARG1 | 543944 | protein | Increase | SEQ ID NO: 217 | SEQ ID NO: 559 |
| Abiotic stress | ARS1 | 101257705 | protein | Increase | SEQ ID NO: 218 | SEQ ID NO: 560 |
| Abiotic stress | CAB5 | 543976 | protein | Increase | SEQ ID NO: 219 | SEQ ID NO: 561 |
| Abiotic stress | CYP97C11 | 100322877 | protein | Increase | SEQ ID NO: 220 | SEQ ID NO: 562 |
| Abiotic stress | DEAD31 | 101257016 | protein | Increase | SEQ ID NO: 221 | SEQ ID NO: 563 |
| Abiotic stress | dhn | 101253585 | protein | Increase | SEQ ID NO: 222 | SEQ ID NO: 564 |
| Abiotic stress | DOT | 100301925 | protein | Increase/Decrease | SEQ ID NO: 223 | SEQ ID NO: 565 |
| Abiotic stress | EREB | 543712 | protein | Increase | SEQ ID NO: 224 | SEQ ID NO: 566 |
| Abiotic stress | ERF1 | 606712 | protein | Increase | SEQ ID NO: 225 | SEQ ID NO: 567 |
| Abiotic stress | ERF2 | 543866 | protein | Increase | SEQ ID NO: 226 | SEQ ID NO: 568 |
| Abiotic stress | ERF3 | 544260 | protein | Increase | SEQ ID NO: 227 | SEQ ID NO: 569 |
| Abiotic stress | ERF4 | 543867 | protein | Decrease | SEQ ID NO: 228 | SEQ ID NO: 570 |
| Abiotic stress | ERF5 | 108511945 | protein | Increase | SEQ ID NO: 229 | SEQ ID NO: 571 |
| Abiotic stress | GGP | 101055572 | protein | Increase | SEQ ID NO: 230 | SEQ ID NO: 572 |
| Abiotic stress | GPAT | 543901 | protein | Increase | SEQ ID NO: 231 | SEQ ID NO: 573 |
| Abiotic stress | GRX1 | 100505458 | protein | Increase | SEQ ID NO: 232 | SEQ ID NO: 574 |
| Abiotic stress | HSF8 | 101263626 | protein | Increase | SEQ ID NO: 233 | SEQ ID NO: 575 |
| Abiotic stress | HSP21 | 544024 | protein | Increase | SEQ ID NO: 234 | SEQ ID NO: 576 |
| Abiotic stress | ICE1a | 101248492 | protein | Increase | SEQ ID NO: 235 | SEQ ID NO: 577 |
| Abiotic stress | JERF1 | 544182 | protein | Increase | SEQ ID NO: 236 | SEQ ID NO: 578 |
| Abiotic stress | LeNCED1 | 544163 | protein | Increase | SEQ ID NO: 237 | SEQ ID NO: 579 |
| Abiotic stress | LOC100736527 | 100736527 | protein | Increase | SEQ ID NO: 238 | SEQ ID NO: 580 |
| Abiotic stress | LOC101244577 | 101244577 | protein | Increase | SEQ ID NO: 239 | SEQ ID NO: 581 |
| Abiotic stress | LOC101248009 | 101248009 | protein | Increase | SEQ ID NO: 240 | SEQ ID NO: 582 |
| Abiotic stress | LOC101252194 | 101252194 | protein | Increase | SEQ ID NO: 241 | SEQ ID NO: 583 |
| Abiotic stress | LOC101255098 | 101255098 | protein | Increase | SEQ ID NO: 242 | SEQ ID NO: 584 |
| Abiotic stress | LOC101255672 | 101255672 | protein | Increase | SEQ ID NO: 243 | SEQ ID NO: 585 |
| Abiotic stress | LOC101259420 | 101259420 | protein | Decrease | SEQ ID NO: 244 | SEQ ID NO: 586 |
| Abiotic stress | LOC101261563 | 101261563 | protein | Increase/Decrease | SEQ ID NO: 245 | SEQ ID NO: 587 |
| Abiotic stress | LOC101261712 | 101261712 | protein | Increase | SEQ ID NO: 246 | SEQ ID NO: 588 |
| Abiotic stress | LOC101268417 | 101268417 | protein | AA change | SEQ ID NO: 247 | SEQ ID NO: 589 |
| Abiotic stress | LOC107007292 | 107007292 | protein | Decrease | SEQ ID NO: 248 | SEQ ID NO: 590 |
| Abiotic stress | LOC107018091 | 107018091 | protein | Increase | SEQ ID NO: 249 | SEQ ID NO: 591 |
| Abiotic stress | LOC107026408 | 107026408 | protein | Increase | SEQ ID NO: 250 | SEQ ID NO: 592 |
| Abiotic stress | LOC107031395 | 107031395 | protein | Increase | SEQ ID NO: 251 | SEQ ID NO: 593 |
| Abiotic stress | LOC543729 | 543729 | protein | Decrease | SEQ ID NO: 252 | SEQ ID NO: 594 |
| Abiotic stress | LOC543910 | 543910 | protein | Increase | SEQ ID NO: 253 | SEQ ID NO: 595 |
| Abiotic stress | LOC543989 | 543989 | protein | Increase | SEQ ID NO: 254 | SEQ ID NO: 596 |
| Abiotic stress | MTSHP | 543507 | protein | Increase | SEQ ID NO: 255 | SEQ ID NO: 597 |
| Abiotic stress | NAC1 | 543917 | protein | Increase/Decrease | SEQ ID NO: 256 | SEQ ID NO: 598 |
| Abiotic stress | NAM1 | 100301926 | protein | Increase | SEQ ID NO: 257 | SEQ ID NO: 599 |
| Abiotic stress | NHX2 | 544178 | protein | Increase | SEQ ID NO: 258 | SEQ ID NO: 600 |
| Abiotic stress | RBOH1 | 543571 | protein | Increase/Decrease | SEQ ID NO: 259 | SEQ ID NO: 601 |
| Abiotic stress | SBPase | 100316873 | protein | Increase | SEQ ID NO: 260 | SEQ ID NO: 602 |
| Abiotic stress | SIZ1 | 101252253 | protein | Increase | SEQ ID NO: 261 | SEQ ID NO: 603 |

TABLE 5-continued

| Trait | Gene(s) | Gene ID | Gene Product | Expression Change | Gene SEQ ID | Protein SEQ ID |
|---|---|---|---|---|---|---|
| Abiotic stress | SlDof22 | 101255410 | protein | Increase | SEQ ID NO: 262 | SEQ ID NO: 604 |
| Abiotic stress | SlGGP-LIKE | 101255942 | protein | Increase | SEQ ID NO: 263 | SEQ ID NO: 605 |
| Abiotic stress | SlIPT4 | 100874543 | protein | Increase | SEQ ID NO: 264 | SEQ ID NO: 606 |
| Abiotic stress | SlWRKY33A | 101255501 | protein | Increase | SEQ ID NO: 265 | SEQ ID NO: 607 |
| Abiotic stress | TAS14 | 544056 | protein | Increase | SEQ ID NO: 266 | SEQ ID NO: 608 |
| Abiotic stress | VKOR | 100037492 | protein | Increase | SEQ ID NO: 267 | SEQ ID NO: 609 |
| Architecture | 20ox-1 | 543553 | protein | Decrease | SEQ ID NO: 268 | SEQ ID NO: 610 |
| Architecture | ACS2 | 606304 | protein | Decrease | SEQ ID NO: 269 | SEQ ID NO: 611 |
| Architecture | ACS3 | 778292 | protein | Decrease | SEQ ID NO: 270 | SEQ ID NO: 612 |
| Architecture | ACS4 | 778356 | protein | Decrease | SEQ ID NO: 271 | SEQ ID NO: 613 |
| Architecture | AG1 | 543840 | protein | Increase/Decrease | SEQ ID NO: 272 | SEQ ID NO: 614 |
| Architecture | AGO1B | 101255074 | protein | Increase/Decrease | SEQ ID NO: 273 | SEQ ID NO: 615 |
| Architecture | AGO7 | 101055594 | protein | Increase | SEQ ID NO: 274 | SEQ ID NO: 616 |
| Architecture | ARF10 | 100529137 | protein | Decrease | SEQ ID NO: 275 | SEQ ID NO: 617 |
| Architecture | ARF2A | 778240 | protein | Increase/Decrease | SEQ ID NO: 276 | SEQ ID NO: 618 |
| Architecture | ARF3 | 778363 | protein | Increase/Decrease | SEQ ID NO: 277 | SEQ ID NO: 619 |
| Architecture | ARF4 | 778241 | protein | Increase/Decrease | SEQ ID NO: 278 | SEQ ID NO: 620 |
| Architecture | ARF5 | 100736448 | protein | Increase/Decrease | SEQ ID NO: 279 | SEQ ID NO: 621 |
| Architecture | ARF6 | 100316890 | protein | Increase/Decrease | SEQ ID NO: 280 | SEQ ID NO: 622 |
| Architecture | ARF9 | 100736445 | protein | Increase/Decrease | SEQ ID NO: 281 | SEQ ID NO: 623 |
| Architecture | ASH1 | 101253900 | protein | Increase | SEQ ID NO: 282 | SEQ ID NO: 624 |
| Architecture | ASH2 | 101255998 | protein | Increase | SEQ ID NO: 283 | |
| Architecture | BAM1 | 100736451 | protein | Increase | SEQ ID NO: 284 | SEQ ID NO: 626 |
| Architecture | Bl | 543703 | protein | Increase | SEQ ID NO: 285 | SEQ ID NO: 627 |
| Architecture | CCD7 | 100313501 | protein | Increase/Decrease | SEQ ID NO: 286 | SEQ ID NO: 628 |
| Architecture | Cel1 | 543995 | protein | Decrease | SEQ ID NO: 287 | SEQ ID NO: 629 |
| Architecture | Cel2 | 543996 | protein | Increase/Decrease | SEQ ID NO: 288 | SEQ ID NO: 630 |
| Architecture | CLV2 | 100736246 | protein | Decrease | SEQ ID NO: 289 | SEQ ID NO: 631 |
| Architecture | CRY1a | 544219 | protein | Increase | SEQ ID NO: 290 | SEQ ID NO: 632 |
| Architecture | CSR | 101262990 | protein | Increase/Decrease | SEQ ID NO: 291 | SEQ ID NO: 633 |
| Architecture | CURL3 | 101261320 | protein | Increase | SEQ ID NO: 292 | SEQ ID NO: 634 |
| Architecture | CycA1 | 543744 | protein | Increase | SEQ ID NO: 293 | SEQ ID NO: 635 |
| Architecture | CYP | 100736432 | protein | Increase/Decrease | SEQ ID NO: 294 | SEQ ID NO: 636 |
| Architecture | CYP85A1 | 100037489 | protein | Increase | SEQ ID NO: 295 | SEQ ID NO: 637 |
| Architecture | CYP85A3 | 100136888 | protein | Increase | SEQ ID NO: 296 | SEQ ID NO: 638 |
| Architecture | DDB1 | 778355 | protein | Decrease | SEQ ID NO: 297 | SEQ ID NO: 639 |
| Architecture | DES | 543675 | protein | Increase | SEQ ID NO: 298 | SEQ ID NO: 640 |
| Architecture | DET1 | 778329 | protein | Increase/Decrease | SEQ ID NO: 299 | SEQ ID NO: 641 |
| Architecture | DHAR2 | 778343 | protein | Increase | SEQ ID NO: 300 | SEQ ID NO: 642 |
| Architecture | DOT | 100301925 | protein | Increase/Decrease | SEQ ID NO: 301 | SEQ ID NO: 643 |
| Architecture | ETR1 | 606298 | protein | Decrease | SEQ ID NO: 302 | SEQ ID NO: 644 |
| Architecture | ETR2 | 606299 | protein | Decrease | SEQ ID NO: 303 | SEQ ID NO: 645 |
| Architecture | FALSIFLORA | 543630 | protein | Increase/Decrease | SEQ ID NO: 304 | SEQ ID NO: 646 |
| Architecture | FRK2 | 544022 | protein | Increase | SEQ ID NO: 305 | SEQ ID NO: 647 |
| Architecture | FYFL | 101266695 | protein | Increase | SEQ ID NO: 306 | SEQ ID NO: 648 |
| Architecture | FZY | 100037507 | protein | Decrease | SEQ ID NO: 307 | SEQ ID NO: 649 |
| Architecture | GA2ox1 | 100134907 | protein | Increase/Decrease | SEQ ID NO: 308 | SEQ ID NO: 650 |
| Architecture | GA2ox2 | 100037505 | protein | Decrease | SEQ ID NO: 309 | SEQ ID NO: 651 |
| Architecture | GA2ox4 | 100134889 | protein | Increase | SEQ ID NO: 310 | SEQ ID NO: 652 |
| Architecture | GA2ox5 | 100134890 | protein | Increase | SEQ ID NO: 311 | SEQ ID NO: 653 |
| Architecture | GGPS2 | 778360 | protein | Increase | SEQ ID NO: 312 | SEQ ID NO: 654 |
| Architecture | GLK1 | 101055587 | protein | Increase | SEQ ID NO: 313 | SEQ ID NO: 655 |
| Architecture | GLK2 | 101055613 | protein | Decrease | SEQ ID NO: 314 | SEQ ID NO: 656 |
| Architecture | HO1 | 101257539 | protein | Increase | SEQ ID NO: 315 | SEQ ID NO: 657 |
| Architecture | IAA10 | 543544 | protein | Decrease | SEQ ID NO: 316 | SEQ ID NO: 658 |
| Architecture | J2 | 101263981 | protein | Decrease | SEQ ID NO: 317 | SEQ ID NO: 659 |
| Architecture | LeDEF | 778307 | protein | Increase/Decrease | SEQ ID NO: 318 | SEQ ID NO: 660 |
| Architecture | LOC100301933 | 100301933 | protein | Increase/Decrease | SEQ ID NO: 319 | SEQ ID NO: 661 |
| Architecture | LOC100301945 | 100301945 | protein | Increase/Decrease | SEQ ID NO: 320 | SEQ ID NO: 662 |
| Architecture | LOC101261618 | 101261618 | protein | Decrease | SEQ ID NO: 321 | SEQ ID NO: 663 |
| Architecture | Ls | 543584 | protein | Increase/Decrease | SEQ ID NO: 322 | SEQ ID NO: 664 |
| Architecture | MADS-MC | 543707 | protein | Increase/Decrease | SEQ ID NO: 323 | SEQ ID NO: 665 |
| Architecture | MSI1 | 543534 | protein | Increase/Decrease | SEQ ID NO: 324 | SEQ ID NO: 666 |
| Architecture | MTS1 | 778246 | protein | Increase | SEQ ID NO: 325 | SEQ ID NO: 667 |
| Architecture | MYC2 | 544165 | protein | Increase/Decrease | SEQ ID NO: 326 | SEQ ID NO: 668 |
| Architecture | NAC1 | 543917 | protein | Increase/Decrease | SEQ ID NO: 327 | SEQ ID NO: 669 |
| Architecture | ODC | 544209 | protein | AA change | SEQ ID NO: 328 | SEQ ID NO: 670 |
| Architecture | ORFX | 101245309 | protein | Decrease | SEQ ID NO: 329 | SEQ ID NO: 671 |
| Architecture | OVATE | 543847 | protein | Increase/Decrease | SEQ ID NO: 330 | SEQ ID NO: 672 |
| Architecture | PG2 | 544051 | protein | Increase/Decrease | SEQ ID NO: 331 | SEQ ID NO: 673 |
| Architecture | PGH1 | 544068 | protein | Decrease | SEQ ID NO: 332 | SEQ ID NO: 674 |
| Architecture | phyA | 544176 | protein | Decrease | SEQ ID NO: 333 | SEQ ID NO: 675 |
| Architecture | PHYB2 | 101264523 | protein | Decrease | SEQ ID NO: 334 | SEQ ID NO: 676 |
| Architecture | PHYE | 101253446 | protein | Decrease | SEQ ID NO: 335 | SEQ ID NO: 677 |
| Architecture | PIN2 | 100527966 | protein | Increase/Decrease | SEQ ID NO: 336 | SEQ ID NO: 678 |
| Architecture | PIN3 | 100527967 | protein | Increase/Decrease | SEQ ID NO: 337 | SEQ ID NO: 679 |
| Architecture | PIN4 | 100527968 | protein | Increase/Decrease | SEQ ID NO: 338 | SEQ ID NO: 680 |

TABLE 5-continued

| Trait | Gene(s) | Gene ID | Gene Product | Expression Change | Gene SEQ ID | Protein SEQ ID |
|---|---|---|---|---|---|---|
| Architecture | PIN7 | 100527971 | protein | Increase/Decrease | SEQ ID NO: 339 | SEQ ID NO: 681 |
| Architecture | PIN9 | 100527974 | protein | Increase/Decrease | SEQ ID NO: 340 | SEQ ID NO: 682 |
| Architecture | PRO1 | 544018 | protein | Decrease | SEQ ID NO: 341 | SEQ ID NO: 683 |
| Architecture | PSY1 | 543988 | protein | Increase | SEQ ID NO: 342 | SEQ ID NO: 684 |
| Architecture | PT1 | 544136 | protein | Increase | SEQ ID NO: 343 | SEQ ID NO: 685 |
| Architecture | PT2 | 543546 | protein | Increase | SEQ ID NO: 344 | SEQ ID NO: 686 |
| Architecture | PTS | 100191115 | protein | Decrease | SEQ ID NO: 345 | SEQ ID NO: 687 |
| Architecture | Rab11a | 543749 | protein | Increase/Decrease | SEQ ID NO: 346 | SEQ ID NO: 688 |
| Architecture | Rab1A | 544010 | protein | Increase/Decrease | SEQ ID NO: 347 | SEQ ID NO: 689 |
| Architecture | RBOH1 | 543571 | protein | Increase | SEQ ID NO: 348 | SEQ ID NO: 690 |
| Architecture | RSI-1 | 543963 | protein | Increase | SEQ ID NO: 349 | SEQ ID NO: 691 |
| Architecture | S | 100240705 | protein | Decrease | SEQ ID NO: 350 | SEQ ID NO: 692 |
| Architecture | SAMDC | 100134880 | protein | Decrease | SEQ ID NO: 351 | SEQ ID NO: 693 |
| Architecture | SBPase | 100316873 | protein | Increase | SEQ ID NO: 352 | SEQ ID NO: 694 |
| Architecture | SFT | 101246029 | protein | Increase/Decrease | SEQ ID NO: 353 | SEQ ID NO: 695 |
| Architecture | SlCHR1 | 101248711 | protein | Increase/Decrease | SEQ ID NO: 354 | SEQ ID NO: 696 |
| Architecture | SlERF52 | 101266617 | protein | Decrease | SEQ ID NO: 355 | SEQ ID NO: 697 |
| Architecture | SlGRAS24 | 104648977 | protein | Increase/Decrease | SEQ ID NO: 356 | SEQ ID NO: 698 |
| Architecture | SlHAM | 101252614 | protein | Decrease | SEQ ID NO: 357 | SEQ ID NO: 699 |
| Architecture | SlIAA9 | 543750 | protein | Increase/Decrease | SEQ ID NO: 358 | SEQ ID NO: 700 |
| Architecture | SlMYB117 | 101263611 | protein | Increase | SEQ ID NO: 359 | SEQ ID NO: 701 |
| Architecture | SlscADH1 | 100750250 | protein | Increase/Decrease | SEQ ID NO: 360 | SEQ ID NO: 702 |
| Architecture | SlZFP2 | 108150742 | protein | Increase/Decrease | SEQ ID NO: 361 | SEQ ID NO: 703 |
| Architecture | SP | 544038 | protein | Increase/Decrease | SEQ ID NO: 362 | SEQ ID NO: 704 |
| Architecture | SP2G | 101250270 | protein | Increase/Decrease | SEQ ID NO: 363 | SEQ ID NO: 705 |
| Architecture | SP5G | 101254900 | protein | Increase/Decrease | SEQ ID NO: 364 | SEQ ID NO: 706 |
| Architecture | SPA | 101259741 | protein | Decrease | SEQ ID NO: 365 | SEQ ID NO: 707 |
| Architecture | SPL | 104648581 | protein | Decrease | SEQ ID NO: 366 | SEQ ID NO: 708 |
| Architecture | SUN | 100147716 | protein | Increase/Decrease | SEQ ID NO: 367 | SEQ ID NO: 709 |
| Architecture | TAGL1 | 543841 | protein | Increase | SEQ ID NO: 368 | SEQ ID NO: 710 |
| Architecture | TAPG1 | 544004 | protein | Decrease | SEQ ID NO: 369 | SEQ ID NO: 711 |
| Architecture | TAPG2 | 544188 | protein | Decrease | SEQ ID NO: 370 | SEQ ID NO: 712 |
| Architecture | TAPG4 | 544027 | protein | Decrease | SEQ ID NO: 371 | SEQ ID NO: 713 |
| Architecture | TBP1 | 100147728 | protein | Increase | SEQ ID NO: 372 | SEQ ID NO: 714 |
| Architecture | TCTP | 543941 | protein | Increase | SEQ ID NO: 373 | SEQ ID NO: 715 |
| Architecture | TDR4 | 543839 | protein | Increase | SEQ ID NO: 374 | SEQ ID NO: 716 |
| Architecture | TDR5 | 543885 | protein | Increase | SEQ ID NO: 375 | SEQ ID NO: 717 |
| Architecture | TDR6 | 544255 | protein | Increase | SEQ ID NO: 376 | SEQ ID NO: 718 |
| Architecture | TLOG1 | 101258855 | protein | Increase/Decrease | SEQ ID NO: 377 | SEQ ID NO: 719 |
| Architecture | TM29 | 543770 | protein | Decrease | SEQ ID NO: 378 | SEQ ID NO: 720 |
| Architecture | TPSI1 | 544186 | protein | Increase | SEQ ID NO: 379 | |
| Architecture | wee1 | 778237 | protein | Increase | SEQ ID NO: 380 | SEQ ID NO: 722 |
| Architecture | WUS | 543793 | protein | Increase | SEQ ID NO: 381 | SEQ ID NO: 723 |
| Biotic stress | eIF4E1 | 543653 | protein | AA change | SEQ ID NO: 382 | SEQ ID NO: 724 |
| Biotic stress | eIF4E2 | 101261276 | protein | Knockout | SEQ ID NO: 383 | SEQ ID NO: 725 |
| Biotic stress | EREB | 543712 | protein | Increase | SEQ ID NO: 384 | SEQ ID NO: 726 |
| Biotic stress | GPA1 | 543985 | protein | Increase | SEQ ID NO: 385 | SEQ ID NO: 727 |
| Biotic stress | HSTF24 | 101244435 | protein | Increase | SEQ ID NO: 386 | SEQ ID NO: 728 |
| Biotic stress | J | 101245905 | protein | Increase | SEQ ID NO: 387 | SEQ ID NO: 729 |
| Biotic stress | LOC101248714 | 101248714 | protein | AA change | SEQ ID NO: 388 | SEQ ID NO: 730 |
| Biotic stress | LOC101253982 | 101253982 | protein | Decrease | SEQ ID NO: 389 | SEQ ID NO: 731 |
| Biotic stress | LOC101254347 | 101254347 | protein | Decrease | SEQ ID NO: 390 | SEQ ID NO: 732 |
| Biotic stress | LOC101259548 | 101259548 | protein | Increase | SEQ ID NO: 391 | SEQ ID NO: 733 |
| Biotic stress | LOC101264168 | 101264168 | protein | Increase | SEQ ID NO: 392 | SEQ ID NO: 734 |
| Biotic stress | LOC101266256 | 101266256 | protein | Increase | SEQ ID NO: 393 | SEQ ID NO: 735 |
| Biotic stress | LOC543989 | 543989 | protein | Increase | SEQ ID NO: 394 | SEQ ID NO: 736 |
| Biotic stress | LOC544070 | 544070 | protein | Increase | SEQ ID NO: 395 | SEQ ID NO: 737 |
| Biotic stress | PsbQ | 543931 | protein | Increase | SEQ ID NO: 396 | SEQ ID NO: 738 |
| Biotic stress | PTI1 | 544006 | protein | Increase | SEQ ID NO: 397 | SEQ ID NO: 739 |
| Biotic stress | ptpkis1 | 543778 | protein | Increase | SEQ ID NO: 398 | SEQ ID NO: 740 |
| Biotic stress | RBOH1 | 543571 | protein | Increase | SEQ ID NO: 399 | SEQ ID NO: 741 |
| Biotic stress | Rcr3 | 101251145 | protein | Increase | SEQ ID NO: 400 | SEQ ID NO: 742 |
| Biotic stress | SERK1 | 100736530 | protein | Increase | SEQ ID NO: 401 | SEQ ID NO: 743 |
| Biotic stress | SlSRN1 | 101255476 | protein | Increase | SEQ ID NO: 402 | SEQ ID NO: 744 |
| Biotic stress | SlVRSLip | 101253238 | protein | Increase | SEQ ID NO: 403 | SEQ ID NO: 745 |
| Biotic stress | SlWRKY33A | 101255501 | protein | Increase | SEQ ID NO: 404 | SEQ ID NO: 746 |
| Biotic stress | SN2 | 101245301 | protein | Increase | SEQ ID NO: 405 | SEQ ID NO: 747 |
| Biotic stress | SOS2 | 778340 | protein | Increase | SEQ ID NO: 406 | SEQ ID NO: 748 |
| Biotic stress | Suv | 101266505 | protein | Increase | SEQ ID NO: 407 | SEQ ID NO: 749 |
| Biotic stress | TCP4 | 100736453 | protein | Increase | SEQ ID NO: 408 | SEQ ID NO: 750 |
| Biotic stress | TFT1 | 101243846 | protein | Increase | SEQ ID NO: 409 | SEQ ID NO: 751 |
| Biotic stress | TFT5 | 543565 | protein | Decrease | SEQ ID NO: 410 | SEQ ID NO: 752 |
| Biotic stress | TFT6 | 543562 | protein | Decrease | SEQ ID NO: 411 | SEQ ID NO: 753 |
| Biotic stress | TFT7 | 544213 | protein | Increase | SEQ ID NO: 412 | SEQ ID NO: 754 |
| Biotic stress | TIP | 543951 | protein | Increase | SEQ ID NO: 413 | SEQ ID NO: 755 |
| Biotic stress | TPK1b | 100191126 | protein | Increase | SEQ ID NO: 414 | SEQ ID NO: 756 |
| Biotic stress | Ve1 | 543659 | protein | Increase | SEQ ID NO: 415 | SEQ ID NO: 757 |

TABLE 5-continued

| Trait | Gene(s) | Gene ID | Gene Product | Expression Change | Gene SEQ ID | Protein SEQ ID |
|---|---|---|---|---|---|---|
| Biotic stress | VKOR | 100037492 | protein | Increase | SEQ ID NO: 416 | SEQ ID NO: 758 |
| Biotic stress | WRKY3 | 100736444 | protein | Increase | SEQ ID NO: 417 | SEQ ID NO: 759 |
| Biotic stress | WRKY72 | 100529138 | protein | Increase | SEQ ID NO: 418 | SEQ ID NO: 760 |
| Flowering Time | FALSIFLORA | 543630 | protein | Increase/Decrease | SEQ ID NO: 419 | SEQ ID NO: 761 |
| Flowering Time | LOC101247080 | 101247080 | protein | Increase/Decrease | SEQ ID NO: 420 | SEQ ID NO: 762 |
| Flowering Time | phyA | 544176 | protein | Increase/Decrease | SEQ ID NO: 421 | SEQ ID NO: 763 |
| Flowering Time | PHYB1 | 101262847 | protein | Increase/Decrease | SEQ ID NO: 422 | SEQ ID NO: 764 |
| Flowering Time | S | 100240705 | protein | Increase/Decrease | SEQ ID NO: 423 | SEQ ID NO: 765 |
| Flowering Time | SFT | 101246029 | protein | Increase/Decrease | SEQ ID NO: 424 | SEQ ID NO: 766 |
| Flowering Time | SlGRAS24 | 104648977 | protein | Increase/Decrease | SEQ ID NO: 425 | SEQ ID NO: 767 |
| Flowering Time | SlZFP2 | 108150742 | protein | Increase/Decrease | SEQ ID NO: 426 | SEQ ID NO: 768 |
| Flowering Time | SP | 544038 | protein | Increase/Decrease | SEQ ID NO: 427 | SEQ ID NO: 769 |
| Flowering Time | SP2G | 101250270 | protein | Increase/Decrease | SEQ ID NO: 428 | SEQ ID NO: 770 |
| Flowering Time | SP5G | 101254900 | protein | Increase/Decrease | SEQ ID NO: 429 | SEQ ID NO: 771 |
| Nutrient use efficiency | ANT1 | 543897 | protein | Increase | SEQ ID NO: 430 | SEQ ID NO: 772 |
| Nutrient use efficiency | GMP | 544308 | protein | Increase | SEQ ID NO: 431 | SEQ ID NO: 773 |
| Nutrient use efficiency | SlALMT5 | 101246702 | protein | Increase | SEQ ID NO: 432 | SEQ ID NO: 774 |
| Nutrient use efficiency | SPA | 101259741 | protein | Decrease | SEQ ID NO: 433 | SEQ ID NO: 775 |
| Nutrient use efficiency | SPDSYN | 544177 | protein | Knockout | SEQ ID NO: 434 | SEQ ID NO: 776 |
| Nutrient use efficiency | Wiv-1 | 543502 | protein | Decrease | SEQ ID NO: 435 | SEQ ID NO: 777 |
| Photosynthesis | CYP85A1 | 100037489 | protein | Increase | SEQ ID NO: 436 | SEQ ID NO: 778 |
| Photosynthesis | DDB1 | 778355 | protein | Increase | SEQ ID NO: 437 | SEQ ID NO: 779 |
| Photosynthesis | DHAR2 | 778343 | protein | Increase | SEQ ID NO: 438 | SEQ ID NO: 780 |
| Photosynthesis | ERF1 | 606712 | protein | Increase | SEQ ID NO: 439 | SEQ ID NO: 781 |
| Photosynthesis | GAPC2 | 101258368 | protein | Increase | SEQ ID NO: 440 | SEQ ID NO: 782 |
| Photosynthesis | GAPDH | 100736499 | protein | Increase | SEQ ID NO: 441 | SEQ ID NO: 783 |
| Photosynthesis | GGPS2 | 778360 | protein | Increase | SEQ ID NO: 442 | SEQ ID NO: 784 |
| Photosynthesis | LeNCED1 | 544163 | protein | Increase | SEQ ID NO: 443 | SEQ ID NO: 785 |
| Photosynthesis | LOC101264168 | 101264168 | protein | Increase | SEQ ID NO: 444 | SEQ ID NO: 786 |
| Photosynthesis | LOC543910 | 543910 | protein | Increase | SEQ ID NO: 445 | SEQ ID NO: 787 |
| Photosynthesis | mMDH1 | 778285 | protein | Decrease | SEQ ID NO: 446 | SEQ ID NO: 788 |
| Photosynthesis | MYB | 544113 | protein | Increase | SEQ ID NO: 447 | SEQ ID NO: 789 |
| Photosynthesis | PRO2 | 544281 | protein | Increase | SEQ ID NO: 448 | SEQ ID NO: 790 |
| Photosynthesis | SlMYB117 | 101263611 | protein | Increase | SEQ ID NO: 449 | SEQ ID NO: 791 |
| Photosynthesis | SUT4 | 543620 | protein | Increase | SEQ ID NO: 450 | SEQ ID NO: 792 |
| Photosynthesis | USP | 101256409 | protein | Increase | SEQ ID NO: 451 | SEQ ID NO: 793 |
| Resource partitioning | ACO3 | 101268031 | protein | Decrease | SEQ ID NO: 452 | SEQ ID NO: 794 |
| Resource partitioning | ACS2 | 606304 | protein | Increase | SEQ ID NO: 453 | SEQ ID NO: 795 |
| Resource partitioning | ADH2 | 544074 | protein | Increase | SEQ ID NO: 454 | SEQ ID NO: 796 |
| Resource partitioning | AGO7 | 101055594 | protein | Increase | SEQ ID NO: 455 | SEQ ID NO: 797 |
| Resource partitioning | AO | 778230 | protein | Decrease | SEQ ID NO: 456 | SEQ ID NO: 798 |
| Resource partitioning | cnr | 101256245 | protein | Increase | SEQ ID NO: 457 | SEQ ID NO: 799 |
| Resource partitioning | CURL3 | 101261320 | protein | Increase | SEQ ID NO: 458 | SEQ ID NO: 800 |
| Resource partitioning | CYP85A1 | 100037489 | protein | Increase | SEQ ID NO: 459 | SEQ ID NO: 801 |
| Resource partitioning | CYP85A3 | 100136888 | protein | Increase | SEQ ID NO: 460 | SEQ ID NO: 802 |
| Resource partitioning | DET1 | 778329 | protein | Increase/Decrease | SEQ ID NO: 461 | SEQ ID NO: 803 |
| Resource partitioning | DHAR2 | 778343 | protein | Increase | SEQ ID NO: 462 | SEQ ID NO: 804 |
| Resource partitioning | Dwarfl | 543937 | protein | Decrease | SEQ ID NO: 463 | SEQ ID NO: 805 |
| Resource partitioning | E4 | 101253577 | protein | Increase | SEQ ID NO: 464 | SEQ ID NO: 806 |
| Resource partitioning | E4/E8BP1 | 544026 | protein | Increase | SEQ ID NO: 465 | SEQ ID NO: 807 |
| Resource partitioning | EREBP | 606712 | protein | Decrease | SEQ ID NO: 466 | SEQ ID NO: 808 |
| Resource partitioning | ETR6 | 543834 | protein | Decrease | SEQ ID NO: 467 | SEQ ID NO: 809 |
| Resource partitioning | EXP1 | 544035 | protein | Increase | SEQ ID NO: 468 | SEQ ID NO: 810 |
| Resource partitioning | F3H | 100736482 | protein | Increase | SEQ ID NO: 469 | SEQ ID NO: 811 |
| Resource partitioning | GAD3 | 100147723 | protein | Decrease | SEQ ID NO: 470 | SEQ ID NO: 812 |
| Resource partitioning | HAT22 | 101249144 | protein | Decrease | SEQ ID NO: 471 | SEQ ID NO: 813 |
| Resource partitioning | HMGS | 100134904 | protein | Increase | SEQ ID NO: 472 | SEQ ID NO: 814 |
| Resource partitioning | ht1 | 543737 | protein | Increase | SEQ ID NO: 473 | SEQ ID NO: 815 |
| Resource partitioning | J | 101245905 | protein | Increase/Decrease | SEQ ID NO: 474 | SEQ ID NO: 816 |
| Resource partitioning | J2 | 101263981 | protein | Knockout | SEQ ID NO: 475 | SEQ ID NO: 817 |
| Resource partitioning | Le ACO1 | 544052 | protein | Increase | SEQ ID NO: 476 | SEQ ID NO: 818 |
| Resource partitioning | Le ACS 1A | 544028 | protein | Increase | SEQ ID NO: 477 | SEQ ID NO: 819 |
| Resource partitioning | Le ACS 6 | 606302 | protein | Increase | SEQ ID NO: 478 | SEQ ID NO: 820 |
| Resource partitioning | Le ACS1B | 101246650 | protein | Increase | SEQ ID NO: 479 | SEQ ID NO: 821 |
| Resource partitioning | Le CTR1 | 544127 | protein | Decrease | SEQ ID NO: 480 | SEQ ID NO: 822 |
| Resource partitioning | Le CTR2 | 543725 | protein | Decrease | SEQ ID NO: 481 | SEQ ID NO: 823 |
| Resource partitioning | Le EIL4 | 543518 | protein | Increase | SEQ ID NO: 482 | SEQ ID NO: 824 |
| Resource partitioning | Le EIN2 | 543928 | protein | Increase | SEQ ID NO: 483 | SEQ ID NO: 825 |
| Resource partitioning | Le ERF1 | 606712 | protein | Increase | SEQ ID NO: 484 | SEQ ID NO: 826 |
| Resource partitioning | Le ERF2 | 543866 | protein | Increase | SEQ ID NO: 485 | SEQ ID NO: 827 |
| Resource partitioning | Le ETR3 | 544279 | protein | Increase | SEQ ID NO: 486 | SEQ ID NO: 828 |
| Resource partitioning | Le ETR4 | 543588 | protein | Decrease | SEQ ID NO: 487 | SEQ ID NO: 829 |
| Resource partitioning | Le ETR4 | 543588 | protein | Increase | SEQ ID NO: 488 | SEQ ID NO: 830 |
| Resource partitioning | Le ETR6 | 543834 | protein | Decrease | SEQ ID NO: 489 | SEQ ID NO: 831 |
| Resource partitioning | LeACO3 | 101268031 | protein | Increase | SEQ ID NO: 490 | SEQ ID NO: 832 |
| Resource partitioning | LeACS2 | 606304 | protein | Increase | SEQ ID NO: 491 | SEQ ID NO: 833 |
| Resource partitioning | LeACS4 | 778356 | protein | Increase | SEQ ID NO: 492 | SEQ ID NO: 834 |

TABLE 5-continued

| Trait | Gene(s) | Gene ID | Gene Product | Expression Change | Gene SEQ ID | Protein SEQ ID |
|---|---|---|---|---|---|---|
| Resource partitioning | LeSUT1 | 544099 | protein | Increase | SEQ ID NO: 493 | SEQ ID NO: 835 |
| Resource partitioning | LOC101245211 | 101245211 | protein | Increase | SEQ ID NO: 494 | SEQ ID NO: 836 |
| Resource partitioning | LOC101246179 | 101246179 | protein | Increase | SEQ ID NO: 495 | SEQ ID NO: 837 |
| Resource partitioning | LOC101258398 | 101258398 | protein | Increase | SEQ ID NO: 496 | |
| Resource partitioning | LOC101259144 | 101259144 | protein | Decrease | SEQ ID NO: 497 | SEQ ID NO: 839 |
| Resource partitioning | LOC101259144 | 101259144 | protein | Increase | SEQ ID NO: 498 | SEQ ID NO: 840 |
| Resource partitioning | LOC101263652 | 101263652 | protein | Increase | SEQ ID NO: 499 | SEQ ID NO: 841 |
| Resource partitioning | LOX1.2 | 543997 | protein | Increase | SEQ ID NO: 500 | SEQ ID NO: 842 |
| Resource partitioning | LOXC | 544008 | protein | Increase | SEQ ID NO: 501 | SEQ ID NO: 843 |
| Resource partitioning | MAN2 | 544170 | protein | Decrease | SEQ ID NO: 502 | SEQ ID NO: 844 |
| Resource partitioning | MAN3 | 101248363 | protein | Decrease | SEQ ID NO: 503 | SEQ ID NO: 845 |
| Resource partitioning | MDHAR | 778288 | protein | Increase | SEQ ID NO: 504 | SEQ ID NO: 846 |
| Resource partitioning | MYB | 544113 | protein | Decrease | SEQ ID NO: 505 | SEQ ID NO: 847 |
| Resource partitioning | NAC1 | 543917 | protein | Decrease | SEQ ID NO: 506 | SEQ ID NO: 848 |
| Resource partitioning | NAM | 100301934 | protein | Increase | SEQ ID NO: 507 | SEQ ID NO: 849 |
| Resource partitioning | PIN2 | 100527966 | protein | Increase | SEQ ID NO: 508 | SEQ ID NO: 850 |
| Resource partitioning | PIN3 | 100527967 | protein | Increase | SEQ ID NO: 509 | SEQ ID NO: 851 |
| Resource partitioning | PIN4 | 100527968 | protein | Increase | SEQ ID NO: 510 | SEQ ID NO: 852 |
| Resource partitioning | PIN9 | 100527974 | protein | Increase | SEQ ID NO: 511 | SEQ ID NO: 853 |
| Resource partitioning | PSY | 543988 | protein | Increase | SEQ ID NO: 512 | SEQ ID NO: 854 |
| Resource partitioning | RIN | 543708 | protein | Increase | SEQ ID NO: 513 | SEQ ID NO: 855 |
| Resource partitioning | SFT | 101246029 | protein | Increase/Decrease | SEQ ID NO: 514 | SEQ ID NO: 856 |
| Resource partitioning | SlARF4 | 778241 | protein | Increase | SEQ ID NO: 515 | SEQ ID NO: 857 |
| Resource partitioning | SlCHR1 | 101248711 | protein | Decrease | SEQ ID NO: 516 | SEQ ID NO: 858 |
| Resource partitioning | SlFRK3 | 543890 | protein | Increase | SEQ ID NO: 517 | SEQ ID NO: 859 |
| Resource partitioning | SlMYB117 | 101263611 | protein | Increase | SEQ ID NO: 518 | SEQ ID NO: 860 |
| Resource partitioning | SlVRSLip | 101253238 | protein | Increase | SEQ ID NO: 519 | SEQ ID NO: 861 |
| Resource partitioning | SlVTE5 | 101262393 | protein | Increase | SEQ ID NO: 520 | SEQ ID NO: 862 |
| Resource partitioning | SPA | 101259741 | protein | Decrease | SEQ ID NO: 521 | SEQ ID NO: 863 |
| Resource partitioning | SUT2 | 543613 | protein | Increase | SEQ ID NO: 522 | SEQ ID NO: 864 |
| Resource partitioning | TAGL1 | 543841 | protein | Increase/Decrease | SEQ ID NO: 523 | SEQ ID NO: 865 |
| Resource partitioning | TDR4 | 543839 | protein | Increase | SEQ ID NO: 524 | SEQ ID NO: 866 |
| Resource partitioning | tEG3 | 543736 | protein | Increase/Decrease | SEQ ID NO: 525 | SEQ ID NO: 867 |
| Resource partitioning | Wiv-1 | 543502 | protein | Increase | SEQ ID NO: 526 | SEQ ID NO: 868 |
| Senescence | 9612 | 778293 | protein | Increase/Decrease | SEQ ID NO: 527 | SEQ ID NO: 869 |
| Senescence | ACO4-like | 543506 | protein | Increase | SEQ ID NO: 528 | SEQ ID NO: 870 |
| Senescence | ACS5 | 606300 | protein | Increase | SEQ ID NO: 529 | SEQ ID NO: 871 |
| Senescence | ACS6 | 606302 | protein | Increase | SEQ ID NO: 530 | SEQ ID NO: 872 |
| Senescence | ADC | 543960 | protein | Increase | SEQ ID NO: 531 | SEQ ID NO: 873 |
| Senescence | adc1 | 543807 | protein | Increase | SEQ ID NO: 532 | SEQ ID NO: 874 |
| Senescence | DHS | 543666 | protein | Decrease | SEQ ID NO: 533 | SEQ ID NO: 875 |
| Senescence | DREB1 | 543711 | protein | Increase | SEQ ID NO: 534 | SEQ ID NO: 876 |
| Senescence | EIN2 | 543928 | protein | Increase/Decrease | SEQ ID NO: 535 | SEQ ID NO: 877 |
| Senescence | ETR6 | 543834 | protein | Increase/Decrease | SEQ ID NO: 536 | SEQ ID NO: 878 |
| Senescence | FYFL | 101266695 | protein | Increase | SEQ ID NO: 537 | SEQ ID NO: 879 |
| Senescence | LOC101245211 | 101245211 | protein | Decrease | SEQ ID NO: 538 | SEQ ID NO: 880 |
| Senescence | LOC101246179 | 101246179 | protein | Decrease | SEQ ID NO: 539 | SEQ ID NO: 881 |
| Senescence | LOC101254006 | 101254006 | protein | Increase | SEQ ID NO: 540 | SEQ ID NO: 882 |
| Senescence | LOC101254913 | 101254913 | protein | Increase | SEQ ID NO: 541 | SEQ ID NO: 883 |
| Senescence | LOC101258398 | 101258398 | protein | Decrease | SEQ ID NO: 542 | |
| Senescence | LOC101259118 | 101259118 | protein | Decrease | SEQ ID NO: 543 | SEQ ID NO: 885 |
| Senescence | LOC101265784 | 101265784 | protein | Decrease | SEQ ID NO: 544 | SEQ ID NO: 886 |
| Senescence | LOC543637 | 543637 | protein | Increase | SEQ ID NO: 545 | SEQ ID NO: 887 |
| Senescence | ODD | 100125906 | protein | Decrease | SEQ ID NO: 546 | SEQ ID NO: 888 |
| Senescence | PR1B1 | 544123 | protein | Increase/Decrease | SEQ ID NO: 547 | SEQ ID NO: 889 |
| Senescence | Rcr3 | 101251145 | protein | Increase | SEQ ID NO: 548 | SEQ ID NO: 890 |
| Senescence | SEND33 | 778301 | protein | Increase/Decrease | SEQ ID NO: 549 | SEQ ID NO: 891 |
| Senescence | SlVPE5 | 778274 | protein | Increase | SEQ ID NO: 550 | SEQ ID NO: 892 |
| Senescence | XET4 | 543626 | protein | Increase | SEQ ID NO: 551 | SEQ ID NO: 893 |
| Photosynthesis | PsbS | 101260830 | protein | Increase | SEQ ID NO: 980 | SEQ ID NO: 983 |
| Photosynthesis | VDE | 543696 | protein | Increase | SEQ ID NO: 981 | SEQ ID NO: 984 |
| Photosynthesis | ZEP | 544162 | protein | Increase | SEQ ID NO: 982 | SEQ ID NO: 985 |

All cited patents and patent publications referred to in this application are incorporated herein by reference in their entirety. All of the materials and methods disclosed and claimed herein can be made and used without undue experimentation as instructed by the above disclosure and illustrated by the examples. Although the materials and methods of this invention have been described in terms of embodiments and illustrative examples, it will be apparent to those of skill in the art that substitutions and variations can be applied to the materials and methods described herein without departing from the concept, spirit, and scope of the invention. For instance, while the particular examples provided illustrate the methods and embodiments described herein using a specific plant, the principles in these examples are applicable to any plant of interest; similarly, while the particular examples provided illustrate the methods and embodiments described herein using a particular sequence-specific nuclease such as Cas9, one of skill in the art would recognize that alternative sequence-specific nucleases (e.g., CRISPR nucleases other than Cas9, such as CasX, CasY, and Cpf1, zinc-finger nucleases, transcription activator-like effector nucleases, Argonaute proteins, and meganucleases)

are useful in various embodiments. All such similar substitutes and modifications apparent to those skilled in the art are deemed to be within the spirit, scope, and concept of the invention as encompassed by the embodiments of the inventions recited herein and the specification and appended claims.

SEQUENCE LISTING (985 sequences)

SEQ ID NO: 1 - DNA, 11 bp, Artificial Sequence
  Description of Artificial Sequence: Synthetic construct
cctcgtgtctc

SEQ ID NO: 2 - DNA, 11 bp, Artificial Sequence
  Description of Artificial Sequence: Synthetic construct
ccttttgtctc

SEQ ID NO: 3 - DNA, 11 bp, Artificial Sequence
  Description of Artificial Sequence: Synthetic construct
  modified_base (10)..(10): a, c, t or g
ccttttgtcnc

SEQ ID NO: 4 - DNA, 6 bp, Artificial Sequence
  Description of Artificial Sequence: Synthetic construct
tgtctc

SEQ ID NO: 5 - protein, 5 aa, Artificial Sequence
  Description of Artificial Sequence: Synthetic construct
  MOD_RES (2)..(2): Any naturally occurring amino acid
  MOD_RES (4)..(4): Any naturally occurring amino acid
LXLXL

SEQ ID NO: 6 - protein, 6 aa, Artificial Sequence
  Description of Artificial Sequence: Synthetic construct
  MOD_RES (4)..(5): Any naturally occurring amino acid
DLNXXP

SEQ ID NO: 7 - DNA, 34 bp, Artificial Sequence
  Description of Artificial Sequence: Synthetic construct
ataacttcgtatagcatacattatacgaagttat

SEQ ID NO: 8 - DNA, 34 bp, Artificial Sequence
  Description of Artificial Sequence: Synthetic construct
ataacttcgtataatgtatgctatacgaagttat

SEQ ID NO: 9 - DNA, 34 bp, Artificial Sequence
  Description of Artificial Sequence: Synthetic construct
  modified_base (14)..(16): a, c, t or g
  modified_base (19)..(21): a, c, t or g
ataacttcgtatannntannntatacgaagttat

SEQ ID NO: 10 - DNA, 34 bp, Artificial Sequence
  Description of Artificial Sequence: Synthetic construct
ataacttcgtataatgtatactatacgaagttat

SEQ ID NO: 11 - DNA, 34 bp, Artificial Sequence
  Description of Artificial Sequence: Synthetic construct
ataacttcgtataatgtgtactatacgaagttat

SEQ ID NO: 12 - DNA, 34 bp, Artificial Sequence
  Description of Artificial Sequence: Synthetic construct
ataacttcgtataaagtatcctatacgaagttat

SEQ ID NO: 13 - DNA, 34 bp, Artificial Sequence
  Description of Artificial Sequence: Synthetic construct
ataacttcgtataagaaaccatatacgaagttat

SEQ ID NO: 14 - DNA, 34 bp, Artificial Sequence
  Description of Artificial Sequence: Synthetic construct
ataacttcgtatataataccatatacgaagttat

SEQ ID NO: 15 - DNA, 34 bp, Artificial Sequence
  Description of Artificial Sequence: Synthetic construct
ataacttcgtataagatagaatatacgaagttat

SEQ ID NO: 16 - DNA, 34 bp, Artificial Sequence; identical to SEQ ID NO: 15
  Description of Artificial Sequence: Synthetic construct

SEQ ID NO: 17 - DNA, 34 bp, Artificial Sequence
  Description of Artificial Sequence: Synthetic construct
  modified_base (14)..(16): a, c, t or g
  modified_base (19)..(21): a, c, t or g
taccgttcgtatannntannntatacgaagttat

SEQ ID NO: 18 - DNA, 34 bp, Artificial Sequence
  Description of Artificial Sequence: Synthetic construct
  modified_base (14)..(16): a, c, t or g
  modified_base (19)..(21): a, c, t or g
ataacttcgtatannntannntatacgaacggta

SEQ ID NO: 19 - DNA, 8 bp, Artificial Sequence
  Description of Artificial Sequence: Synthetic construct
cacgtggc

SEQ ID NO: 20 - DNA, 8 bp, Artificial Sequence
  Description of Artificial Sequence: Synthetic construct
yacgtggc

SEQ ID NO: 21 - DNA, 8 bp, Artificial Sequence
  Description of Artificial Sequence: Synthetic construct
bacgtgkm

SEQ ID NO: 22 - DNA, 10 bp, Artificial Sequence
  Description of Artificial Sequence: Synthetic construct
gacacgtaga

SEQ ID NO: 23 - DNA, 14 bp, Artificial Sequence
  Description of Artificial Sequence: Synthetic construct
ttdccwwwwwwggh

SEQ ID NO: 24 - DNA, 11 bp, Artificial Sequence
  Description of Artificial Sequence: Synthetic construct
ccatttttagt

SEQ ID NO: 25 - DNA, 10 bp, Artificial Sequence
  Description of Artificial Sequence: Synthetic construct
ccatttttgg

SEQ ID NO: 26 - DNA, 18 bp, Artificial Sequence
  Description of Artificial Sequence: Synthetic construct
  modified_base (1)..(1): a, c, t or g
  modified_base (11)..(12): a, c, t or g
  modified_base (18)..(18): a, c, t or g
nttdccwwwwnnggwaan

SEQ ID NO: 27 - DNA, 18 bp, Artificial Sequence
  Description of Artificial Sequence: Synthetic construct
  modified_base (1)..(2): a, c, t or g
  modified_base (4)..(4): a, c, t or g
  modified_base (18)..(18): a, c, t or g
nnwnccawwwwtrgwwan

SEQ ID NO: 28 - DNA, 16 bp, Artificial Sequence
  Description of Artificial Sequence: Synthetic construct
ttwcyawwwwtrgwaa

SEQ ID NO: 29 - DNA, 10 bp, Artificial Sequence
  Description of Artificial Sequence: Synthetic construct
ccatttttag

SEQ ID NO: 30 - DNA, 10 bp, Artificial Sequence
  Description of Artificial Sequence: Synthetic construct
ccatttttgg

SEQ ID NO: 31 - DNA, 6 bp, Artificial Sequence
  Description of Artificial Sequence: Synthetic construct
tgtctc

SEQ ID NO: 32 - DNA, 6 bp, Artificial Sequence
  Description of Artificial Sequence: Synthetic construct
tgtctc

SEQ ID NO: 33 - DNA, 9 bp, Artificial Sequence
  Description of Artificial Sequence: Synthetic construct
caatwattg

SEQ ID NO: 34 - DNA, 9 bp, Artificial Sequence
  Description of Artificial Sequence: Synthetic construct
caatsattg

SEQ ID NO: 35 - DNA, 9 bp, Artificial Sequence
  Description of Artificial Sequence: Synthetic construct
  modified_base (5)..(5): a, c, t or g
caatnattg

SEQ ID NO: 36 - DNA, 9 bp, Artificial Sequence
  Description of Artificial Sequence: Synthetic construct
caattatta

SEQ ID NO: 37 - DNA, 7 bp, Artificial Sequence
  Description of Artificial Sequence: Synthetic construct
ctaacca

SEQ ID NO: 38 - DNA, 6 bp, Artificial Sequence
  Description of Artificial Sequence: Synthetic construct
cacatg

SEQ ID NO: 39 - DNA, 6 bp, Artificial Sequence
  Description of Artificial Sequence: Synthetic construct
ggttaa

SEQ ID NO: 40 - DNA, 10 bp, Artificial Sequence
  Description of Artificial Sequence: Synthetic construct
ccwwwwwwgg

SEQ ID NO: 41 - DNA, 18 bp, Artificial Sequence
  Description of Artificial Sequence: Synthetic construct
gtttacataaatggaaaa

SEQ ID NO: 42 - DNA, 18 bp, Artificial Sequence
  Description of Artificial Sequence: Synthetic construct
cttacctttcatggatta

SEQ ID NO: 43 - DNA, 18 bp, Artificial Sequence
  Description of Artificial Sequence: Synthetic construct
ctttccatttttagtaac

SEQ ID NO: 44 - DNA, 8 bp, Artificial Sequence
  Description of Artificial Sequence: Synthetic construct
tggccgac

SEQ ID NO: 45 - DNA, 8 bp, Artificial Sequence
  Description of Artificial Sequence: Synthetic construct
ccacgtgg

SEQ ID NO: 46 - DNA, 8 bp, Artificial Sequence
  Description of Artificial Sequence: Synthetic construct
aamaatct

SEQ ID NO: 47 - DNA, 10 bp, Artificial Sequence
  Description of Artificial Sequence: Synthetic construct
aaacaatcta

SEQ ID NO: 48 - DNA, 15 bp, Artificial Sequence
  Description of Artificial Sequence: Synthetic construct
aaaaaaaatctatga

SEQ ID NO: 49 - DNA, 7 bp, Artificial Sequence
  Description of Artificial Sequence: Synthetic construct
  modified_base (5)..(6): a, c, t or g
acacnng

SEQ ID NO: 50 - DNA, 9 bp, Artificial Sequence
  Description of Artificial Sequence: Synthetic construct
taccgacat

SEQ ID NO: 51 - DNA, 9 bp, Artificial Sequence
  Description of Artificial Sequence: Synthetic construct
taccgacat

SEQ ID NO: 52 - DNA, 9 bp, Artificial Sequence
  Description of Artificial Sequence: Synthetic construct
  modified_base (8)..(8): a, c, t or g
drccgacnw

SEQ ID NO: 53 - DNA, 8 bp, Artificial Sequence
  Description of Artificial Sequence: Synthetic construct
tttcccgc

SEQ ID NO: 54 - DNA, 8 bp, Artificial Sequence
  Description of Artificial Sequence: Synthetic construct
tttcccgc

SEQ ID NO: 55 - DNA, 9 bp, Artificial Sequence
  Description of Artificial Sequence: Synthetic construct
tctcccgcc

SEQ ID NO: 56 - DNA, 23 bp, Artificial Sequence
  Description of Artificial Sequence: Synthetic construct
ttcaagggggcatgtatcttgaa

SEQ ID NO: 57 - DNA, 23 bp, Artificial Sequence
  Description of Artificial Sequence: Synthetic construct
ttcaagggggcatgtatcttgaa

SEQ ID NO: 58 - DNA, 23 bp, Artificial Sequence
  Description of Artificial Sequence: Synthetic construct
ttcaagggggcatgtatcttgaa

SEQ ID NO: 59 - DNA, 29 bp, Artificial Sequence
  Description of Artificial Sequence: Synthetic construct
ggattcaagggggcatgtatcttgaatcc

SEQ ID NO: 60 - DNA, 11 bp, Artificial Sequence
  Description of Artificial Sequence: Synthetic construct
taagagccgcc

SEQ ID NO: 61 - DNA, 6 bp, Artificial Sequence
  Description of Artificial Sequence: Synthetic construct
gccgcc

SEQ ID NO: 62 - DNA, 9 bp, Artificial Sequence
  Description of Artificial Sequence: Synthetic construct
aaaatatct

SEQ ID NO: 63 - DNA, 6 bp, Artificial Sequence
  Description of Artificial Sequence: Synthetic construct
wgatar

SEQ ID NO: 64 - DNA, 8 bp, Artificial Sequence
  Description of Artificial Sequence: Synthetic construct
ccacgtgg

SEQ ID NO: 65 - DNA, 6 bp, Artificial Sequence
  Description of Artificial Sequence: Synthetic construct
cacgtg

SEQ ID NO: 66 - DNA, 6 bp, Artificial Sequence
  Description of Artificial Sequence: Synthetic construct
gccgcc

SEQ ID NO: 67 - DNA, 15 bp, Artificial Sequence
  Description of Artificial Sequence: Synthetic construct
tgtgtggttaatatg

SEQ ID NO: 68 - DNA, 6 bp, Artificial Sequence
  Description of Artificial Sequence: Synthetic construct
ccgtcg

SEQ ID NO: 69 - DNA, 10 bp, Artificial Sequence
  Description of Artificial Sequence: Synthetic construct
  modified_base (5)..(6): a, c, t or g
agaannttct

SEQ ID NO: 70 - DNA, 6 bp, Artificial Sequence
  Description of Artificial Sequence: Synthetic construct
gataag

SEQ ID NO: 71 - DNA, 10 bp, Artificial Sequence
  Description of Artificial Sequence: Synthetic construct
cgtcaatgaa

SEQ ID NO: 72 - DNA, 13 bp, Artificial Sequence
  Description of Artificial Sequence: Synthetic construct
catacgtcgtcaa

SEQ ID NO: 73 - DNA, 8 bp, Artificial Sequence
  Description of Artificial Sequence: Synthetic construct
taaatgya

SEQ ID NO: 74 - DNA, 10 bp, Artificial Sequence
  Description of Artificial Sequence: Synthetic construct
acgtcataga

SEQ ID NO: 75 - DNA, 10 bp, Artificial Sequence
  Description of Artificial Sequence: Synthetic construct
tctacgtcac

SEQ ID NO: 76 - DNA, 7 bp, Artificial Sequence
  Description of Artificial Sequence: Synthetic construct
accgaca

SEQ ID NO: 77 - DNA, 12 bp, Artificial Sequence
  Description of Artificial Sequence: Synthetic construct
tctaacctacca

SEQ ID NO: 78 - DNA, 8 bp, Artificial Sequence
  Description of Artificial Sequence: Synthetic construct
maccwamc

SEQ ID NO: 79 - DNA, 8 bp, Artificial Sequence
  Description of Artificial Sequence: Synthetic construct
mtccwacc

SEQ ID NO: 80 - DNA, 9 bp, Artificial Sequence
  Description of Artificial Sequence: Synthetic construct
taactsgtt

SEQ ID NO: 81 - DNA, 8 bp, Artificial Sequence
  Description of Artificial Sequence: Synthetic construct
taactaac

SEQ ID NO: 82 - DNA, 7 bp, Artificial Sequence
  Description of Artificial Sequence: Synthetic construct
amcwamc

SEQ ID NO: 83 - DNA, 9 bp, Artificial Sequence
  Description of Artificial Sequence: Synthetic construct
agatcgacg

SEQ ID NO: 84 - DNA, 26 bp, Artificial Sequence
  Description of Artificial Sequence: Synthetic construct
atcttatgtcattgatgacgacctcc

SEQ ID NO: 85 - DNA, 11 bp, Artificial Sequence
  Description of Artificial Sequence: Synthetic construct
tacacttttgg

SEQ ID NO: 86 - DNA, 20 bp, Artificial Sequence
  Description of Artificial Sequence: Synthetic construct
tgacgyaagsrmtkacgymm

SEQ ID NO: 87 - DNA, 8 bp, Artificial Sequence
  Description of Artificial Sequence: Synthetic construct
cgcggatc

SEQ ID NO: 88 - DNA, 8 bp, Artificial Sequence
  Description of Artificial Sequence: Synthetic construct
gtgatcac

SEQ ID NO: 89 - DNA, 20 bp, Artificial Sequence
  Description of Artificial Sequence: Synthetic construct
ttggttttgatcaaaaccaa

SEQ ID NO: 90 - DNA, 15 bp, Artificial Sequence
  Description of Artificial Sequence: Synthetic construct
taattgactcaatta

SEQ ID NO: 91 - DNA, 5 bp, Artificial Sequence
  Description of Artificial Sequence: Synthetic construct
caaca

SEQ ID NO: 92 - DNA, 6 bp, Artificial Sequence
  Description of Artificial Sequence: Synthetic construct
cacctg

SEQ ID NO: 93 - DNA, 8 bp, Artificial Sequence
  Description of Artificial Sequence: Synthetic construct
catgcatg

SEQ ID NO: 94 - DNA, 9 bp, Artificial Sequence
  Description of Artificial Sequence: Synthetic construct
  modified_base (2)..(2): a, c, t or g
tncgtacaa

SEQ ID NO: 95 - DNA, 6 bp, Artificial Sequence
  Description of Artificial Sequence: Synthetic construct
actttg

SEQ ID NO: 96 - DNA, 16 bp, Artificial Sequence
  Description of Artificial Sequence: Synthetic construct
aggggcataatggtaa

SEQ ID NO: 97 - DNA, 9 bp, Artificial Sequence
  Description of Artificial Sequence: Synthetic construct
aaaccctaa

SEQ ID NO: 98 - DNA, 8 bp, Artificial Sequence
  Description of Artificial Sequence: Synthetic construct
tgacgtgg

SEQ ID NO: 99 - DNA, 5 bp, Artificial Sequence
  Description of Artificial Sequence: Synthetic construct
ttgac

SEQ ID NO: 100 - DNA, 8 bp, Artificial Sequence
  Description of Artificial Sequence: Synthetic construct
atacgtgt

SEQ ID NO: 101 - DNA, 16 bp, Artificial Sequence
  Description of Artificial Sequence: Synthetic construct
aaaacagaataggaaa

SEQ ID NO: 102 - DNA, 8 bp, Artificial Sequence
  Description of Artificial Sequence: Synthetic construct
aaattaaa

SEQ ID NO: 103 - DNA, 8 bp, Artificial Sequence
  Description of Artificial Sequence: Synthetic construct
aaattagt

SEQ ID NO: 104 - DNA, 8 bp, Artificial Sequence
  Description of Artificial Sequence: Synthetic construct
actaattt

SEQ ID NO: 105 - DNA, 12 bp, Artificial Sequence
  Description of Artificial Sequence: Synthetic construct
ccaatttaatgg

SEQ ID NO: 106 - DNA, 6 bp, Artificial Sequence
  Description of Artificial Sequence: Synthetic construct
actcat

SEQ ID NO: 107 - DNA, 19 bp, Artificial Sequence
  Description of Artificial Sequence: Synthetic construct
cttaaaccctaggggtaat

SEQ ID NO: 108 - DNA, 10 bp, Artificial Sequence
  Description of Artificial Sequence: Synthetic construct
ttwtactagt

SEQ ID NO: 109 - DNA, 9 bp, Artificial Sequence
  Description of Artificial Sequence: Synthetic construct
ataaaacgt

SEQ ID NO: 110 - DNA, 9 bp, Artificial Sequence
  Description of Artificial Sequence: Synthetic construct
tgtatatat

SEQ ID NO: 111 - DNA, 9 bp, Artificial Sequence
  Description of Artificial Sequence: Synthetic construct
ctcctaatt

SEQ ID NO: 112 - DNA, 10 bp, Artificial Sequence
  Description of Artificial Sequence: Synthetic construct
ttgcatgact

SEQ ID NO: 113 - DNA, 6 bp, Artificial Sequence
  Description of Artificial Sequence: Synthetic construct
agccac

SEQ ID NO: 114 - DNA, 5 bp, Artificial Sequence
  Description of Artificial Sequence: Synthetic construct
gggcc

SEQ ID NO: 115 - DNA, 9 bp, Artificial Sequence
  Description of Artificial Sequence: Synthetic construct
ctcaagtga

SEQ ID NO: 116 - DNA, 9 bp, Artificial Sequence
  Description of Artificial Sequence: Synthetic construct
gtatgatgg

SEQ ID NO: 117 - DNA, 7 bp, Artificial Sequence
  Description of Artificial Sequence: Synthetic construct
gagtgag

SEQ ID NO: 118 - DNA, 8 bp, Artificial Sequence
  Description of Artificial Sequence: Synthetic construct
cacgtggc

SEQ ID NO: 119 - DNA, 34 bp, Artificial Sequence
  Description of Artificial Sequence: Synthetic construct
gtttaattgagttgtcatatgttaataacggtat

SEQ ID NO: 120 - DNA, 34 bp, Artificial Sequence
  Description of Artificial Sequence: Synthetic construct
ataccgttattaacatatgacaactcaattaaac

SEQ ID NO: 121 - DNA, 34 bp, Artificial Sequence
  Description of Artificial Sequence: Synthetic construct
ccgacaaaaggccgacaaaaggccgacaaaaggt

SEQ ID NO: 122 - DNA, 34 bp, Artificial Sequence
  Description of Artificial Sequence: Synthetic construct
accttttgtcggccttttgtcggccttttgtcgg

SEQ ID NO: 123 - DNA, 68 bp, Artificial Sequence
  Description of Artificial Sequence: Synthetic construct
gccgacaaaaggccgacaaaaggccgacaaaaggccgacaaaaggccgacaaaaggccgacaaaaggt

SEQ ID NO: 124 - DNA, 68 bp, Artificial Sequence
  Description of Artificial Sequence: Synthetic construct
accttttgtcggccttttgtcggccttttgtcggccttttgtcggccttttgtcggccttttgtcggc

SEQ ID NO: 125 - DNA, 100 bp, Artificial Sequence
  Description of Artificial Sequence: Synthetic construct
ccgacaaaaggccgacaaaaggccgacaaaaggccgacaaaaggccgacaaaaggccgacaaaaggccgacaaaaggccgacaaaaggccgacaaaaggt

SEQ ID NO: 126 - DNA, 100 bp, Artificial Sequence
  Description of Artificial Sequence: Synthetic construct
accttttgtcggccttttgtcggccttttgtcggccttttgtcggccttttgtcggccttttgtcggccttttgtcggccttttgtcggccttttgtcgg

SEQ ID NO: 127 - DNA, 34 bp, Artificial Sequence; identical to SEQ ID NO: 7
  Description of Artificial Sequence: Synthetic construct

SEQ ID NO: 128 - DNA, 34 bp, Artificial Sequence; identical to SEQ ID NO: 8
  Description of Artificial Sequence: Synthetic construct

SEQ ID NO: 129 - DNA, 34 bp, Artificial Sequence; identical to SEQ ID NO: 9
  Description of Artificial Sequence: Synthetic construct
  modified_base (14)..(16): a, c, t or g
  modified_base (19)..(21): a, c, t or g

SEQ ID NO: 130 - DNA, 34 bp, Artificial Sequence; identical to SEQ ID NO: 10
  Description of Artificial Sequence: Synthetic construct

SEQ ID NO: 131 - DNA, 34 bp, Artificial Sequence; identical to SEQ ID NO: 11
  Description of Artificial Sequence: Synthetic construct

SEQ ID NO: 132 - DNA, 34 bp, Artificial Sequence; identical to SEQ ID NO: 12
  Description of Artificial Sequence: Synthetic construct

SEQ ID NO: 133 - DNA, 34 bp, Artificial Sequence; identical to SEQ ID NO: 13
  Description of Artificial Sequence: Synthetic construct

SEQ ID NO: 134 - DNA, 34 bp, Artificial Sequence; identical to SEQ ID NO: 14
  Description of Artificial Sequence: Synthetic construct

SEQ ID NO: 135 - DNA, 34 bp, Artificial Sequence; identical to SEQ ID NO: 15
  Description of Artificial Sequence: Synthetic construct

SEQ ID NO: 136 - DNA, 34 bp, Artificial Sequence; identical to SEQ ID NO: 15
  Description of Artificial Sequence: Synthetic construct

SEQ ID NO: 137 - DNA, 34 bp, Artificial Sequence; identical to SEQ ID NO: 17
  Description of Artificial Sequence: Synthetic construct
  modified_base (14)..(16): a, c, t or g
  modified_base (19)..(21): a, c, t or g

SEQ ID NO: 138 - DNA, 34 bp, Artificial Sequence; identical to SEQ ID NO: 18
  Description of Artificial Sequence: Synthetic construct
  modified_base (14)..(16): a, c, t or g
  modified_base (19)..(21): a, c, t or g

SEQ ID NO: 139 - DNA, 20 bp, Artificial Sequence
  Description of Artificial Sequence: Synthetic construct
gtgctctctctcttctgtca

SEQ ID NO: 140 - DNA, 20 bp, Artificial Sequence
  Description of Artificial Sequence: Synthetic construct
ctgctctctctcttctgtca

SEQ ID NO: 141 - DNA, 20 bp, Artificial Sequence
  Description of Artificial Sequence: Synthetic construct
ttgcttactctcttctgtca

SEQ ID NO: 142 - DNA, 20 bp, Artificial Sequence
  Description of Artificial Sequence: Synthetic construct
ccgctctctctcttctgtca

SEQ ID NO: 143 - DNA, 21 bp, Artificial Sequence
  Description of Artificial Sequence: Synthetic construct
tggagctcccttcattccaat

SEQ ID NO: 144 - DNA, 21 bp, Artificial Sequence
  Description of Artificial Sequence: Synthetic construct
tcgagttcccttcattccaat

SEQ ID NO: 145 - DNA, 21 bp, Artificial Sequence
  Description of Artificial Sequence: Synthetic construct
atgagctctcttcaaaccaaa

SEQ ID NO: 146 - DNA, 21 bp, Artificial Sequence
  Description of Artificial Sequence: Synthetic construct
tggagctcccttcattccaag

SEQ ID NO: 147 - DNA, 21 bp, Artificial Sequence
  Description of Artificial Sequence: Synthetic construct
tagagcttccttcaaaccaaa

SEQ ID NO: 148 - DNA, 21 bp, Artificial Sequence
  Description of Artificial Sequence: Synthetic construct
tggagctccattcgatccaaa

SEQ ID NO: 149 - DNA, 21 bp, Artificial Sequence
  Description of Artificial Sequence: Synthetic construct
agcagctcccttcaaaccaaa

SEQ ID NO: 150 - DNA, 21 bp, Artificial Sequence
  Description of Artificial Sequence: Synthetic construct
cagagctcccttcactccaat

SEQ ID NO: 151 - DNA, 21 bp, Artificial Sequence
  Description of Artificial Sequence: Synthetic construct
tggagctcccttcactccaat

SEQ ID NO: 152 - DNA, 21 bp, Artificial Sequence
  Description of Artificial Sequence: Synthetic construct
tggagctcccttcactccaag

SEQ ID NO: 153 - DNA, 21 bp, Artificial Sequence
  Description of Artificial Sequence: Synthetic construct
tggagctccctttaatccaat

SEQ ID NO: 154 - DNA, 21 bp, Artificial Sequence
  Description of Artificial Sequence: Synthetic construct
ttgggatgaagcctggtccgg

SEQ ID NO: 155 - DNA, 21 bp, Artificial Sequence
  Description of Artificial Sequence: Synthetic construct
ctgggatgaagcctggtccgg

SEQ ID NO: 156 - DNA, 21 bp, Artificial Sequence
  Description of Artificial Sequence: Synthetic construct
ctggaatgaagcctggtccgg

SEQ ID NO: 157 - DNA, 20 bp, Artificial Sequence
  Description of Artificial Sequence: Synthetic construct
cgggatgaagcctggtccgg

SEQ ID NO: 158 - DNA, 21 bp, Artificial Sequence
  Description of Artificial Sequence: Synthetic construct
gagatcaggctggcagcttgt

SEQ ID NO: 159 - DNA, 21 bp, Artificial Sequence
  Description of Artificial Sequence: Synthetic construct
tagatcaggctggcagcttgt

SEQ ID NO: 160 - DNA, 21 bp, Artificial Sequence
  Description of Artificial Sequence: Synthetic construct
aagatcaggctggcagcttgt

SEQ ID NO: 161 - DNA, 20 bp, Artificial Sequence
  Description of Artificial Sequence: Synthetic construct
gtgctctctctcttctgtca

SEQ ID NO: 162 - DNA, 20 bp, Artificial Sequence
  Description of Artificial Sequence: Synthetic construct
ctgctctctctcttctgtca

SEQ ID NO: 163 - DNA, 20 bp, Artificial Sequence
  Description of Artificial Sequence: Synthetic construct
ttgcttactctcttctgtca

SEQ ID NO: 164 - DNA, 20 bp, Artificial Sequence
  Description of Artificial Sequence: Synthetic construct
ccgctctctctcttctgtca

SEQ ID NO: 165 - DNA, 21 bp, Artificial Sequence
  Description of Artificial Sequence: Synthetic construct
tggcatgcagggagccaggca

SEQ ID NO: 166 - DNA, 21 bp, Artificial Sequence
  Description of Artificial Sequence: Synthetic construct
aggaatacagggagccaggca

SEQ ID NO: 167 - DNA, 21 bp, Artificial Sequence
  Description of Artificial Sequence: Synthetic construct
gggtttacagggagccaggca

SEQ ID NO: 168 - DNA, 21 bp, Artificial Sequence
  Description of Artificial Sequence: Synthetic construct
aggcatacagggagccaggca

SEQ ID NO: 169 - DNA, 21 bp, Artificial Sequence
  Description of Artificial Sequence: Synthetic construct
aaacaatgcgatccctttgga

SEQ ID NO: 170 - DNA, 21 bp, Artificial Sequence
  Description of Artificial Sequence: Synthetic construct
agaccatgcgatccctttgga

SEQ ID NO: 171 - DNA, 21 bp, Artificial Sequence
  Description of Artificial Sequence: Synthetic construct
ggtcagagcgatccctttggc

SEQ ID NO: 172 - DNA, 21 bp, Artificial Sequence
  Description of Artificial Sequence: Synthetic construct
agacaatgcgatccctttgga

SEQ ID NO: 173 - DNA, 22 bp, Artificial Sequence
  Description of Artificial Sequence: Synthetic construct
tcgttcaagaaagcctgtggaa

SEQ ID NO: 174 - DNA, 21 bp, Artificial Sequence
  Description of Artificial Sequence: Synthetic construct
cgttcaagaaagcctgtggaa

SEQ ID NO: 175 - DNA, 22 bp, Artificial Sequence
  Description of Artificial Sequence: Synthetic construct
tcgttcaagaaagcatgtggaa

SEQ ID NO: 176 - DNA, 22 bp, Artificial Sequence
  Description of Artificial Sequence: Synthetic construct
acgttcaagaaagcttgtggaa

SEQ ID NO: 177 - DNA, 21 bp, Artificial Sequence
  Description of Artificial Sequence: Synthetic construct
cgttcaagaaagcctgtggaa

SEQ ID NO: 178 - DNA, 300 bp, Artificial Sequence
  Description of Artificial Sequence: Synthetic construct
ggacaacaagcaccttcttgccttgcaaggcctcccttccctatggtagccacttgagtggatgacttcaccttaaagctattgattccctaagtgccagacataataggctatacattctctctggtggcaacaatgagccattttggttggtgtggtagtctattattgagttttttttggcaccgtactcccatggagagtagaagacaaactcttcaccgttgtagtcgttgatggtattggtggtgacgacatccttggtgtgcatgcactggtgagtcactgttgtactcggcg

SEQ ID NO: 179 - DNA, 104 bp, Artificial Sequence
  Description of Artificial Sequence: Synthetic construct
ggacaacaagcaccttcttgccttgcaaggcctcccttccctatggtagccacttgagtggatgacttcaccttaaagctatcgattccctaagtgccagacat

SEQ ID NO: 180 - DNA, 80 bp, Artificial Sequence
  Description of Artificial Sequence: Synthetic construct
ctcttcaccgttgtagtcgttgatggtattggtggtgacgacatccttggtgtgcatgcactggtgagtcactgttgtac

SEQ ID NO: 181 - DNA, 184 bp, Artificial Sequence
  Description of Artificial Sequence: Synthetic construct
ggacaacaagcaccttcttgccttgcaaggcctcccttccctatggtagccacttgagtggatgacttcaccttaaagctatcgattccctaagtgccagacatctcttcaccgttgtagtcgttgatggtattggtggtgacgacatccttggtgtgcatgcactggtgagtcactgttgtac

SEQ ID NO: 182 - DNA, 184 bp, Artificial Sequence
  Description of Artificial Sequence: Synthetic construct
ctcttcaccgttgtagtcgttgatggtattggtggtgacgacatccttggtgtgcatgcactggtgagtcactgttgtacggacaacaagcaccttcttgccttgcaaggcctcccttccctatggtagccacttgagtggatgacttcaccttaaagctatcgattccctaagtgccagacat

SEQ ID NO: 183 - DNA, 16 bp, Artificial Sequence
  Description of Artificial Sequence: Synthetic construct
acgtaagcgcttacgt

SEQ ID NO: 184 - DNA, 12 bp, Artificial Sequence
  Description of Artificial Sequence: Synthetic construct
gtaagcgcttac

SEQ ID NO: 185 - DNA, 43 bp, Artificial Sequence
  Description of Artificial Sequence: Synthetic construct
aagagatgagctcttgagcaatgtaaagggtcaagttgtttct

SEQ ID NO: 186 - DNA, 43 bp, Artificial Sequence
  Description of Artificial Sequence: Synthetic construct
agaaacaacttgaccctttacattgctcaagagctcatctctt

SEQ ID NO: 187 - RNA, 34 nt, Artificial Sequence
  Description of Artificial Sequence: Synthetic construct
accuuuugucggccuuuugucggccuuuugucgg

SEQ ID NO: 188 - DNA, 38 bp, Artificial Sequence
  Description of Artificial Sequence: Synthetic construct
tcggtccgacaaaaggccgacaaaaggcggacaaaagg

SEQ ID NO: 189 - DNA, 38 bp, Artificial Sequence
  Description of Artificial Sequence: Synthetic construct
accgaccttttgtcggccttttgtcggccttttgtcgg

SEQ ID NO: 190 - DNA, 117 bp, Artificial Sequence
  Description of Artificial Sequence: Synthetic construct
atgggagtagaggcgggcggcggctgcggtgggagggcggtagtcaccggattctacgtctggggctgggagttcctcaccgccctcctgctcttctcggccaccacctcctactag

SEQ ID NO: 191 - DNA, 15 bp, Artificial Sequence
  Description of Artificial Sequence: Synthetic construct
aaaaaaaaaaaaaaa

SEQ ID NO: 192 - DNA, 25 bp, Artificial Sequence
  Description of Artificial Sequence: Synthetic construct
cacatacacacaaaaataaaaaaga

SEQ ID NO: 193 - DNA, 16 bp, Artificial Sequence
  Description of Artificial Sequence: Synthetic construct
gaatatatatatattc

SEQ ID NO: 194 - DNA, 618 bp, Artificial Sequence
  Description of Artificial Sequence: Synthetic construct
gtgaacaaccttatgaaatttgggcgcataacttcgtatagcatacattatacgaagttataaagaactcgccctcaagggttgatcttatgccatcgtcatgataaacagtggagcacggacgatcctttacgttgtttttaacaaactttgtcagaaaactagcatcattaacttcttaatgacgatttcacaacaaaaaaaggtaacctcgctactaacataacaaaatacttgttgcttattaattatatgttttttaatctttgatcaggggacaacagtggttgataacctgttgaacagtgaggatgtccactacatgctcggggccttgaggactcttggtctctctgtcgaagcggacaaagctgccaaaagagctgtagttgttggctgtggtggaaagttcccagttgaggattctaaagaggaagtgcagctcttcttggggaatgctggaattgcaatgcgggcattgacagcagctgttactgctgctggtggaaatgcaacgtatgtttcctctctttctctctacaatacttgcataacttcgtataaagtatcctatacgaagttattggagttagtatgaaacccatgggtatgtctagt

SEQ ID NO: 195 - DNA, 84 bp, Artificial Sequence
  Description of Artificial Sequence: Synthetic construct
tactccctccgtttctttttattagtcgctggatagtgcaattttgcactatccagcgactaataaaaagaaacggagggagta

SEQ ID NO: 196 - DNA, 84 bp, Artificial Sequence
  Description of Artificial Sequence: Synthetic construct
tactccctccgtttctttttattagtcgctggatagtgcaaaattgcactatccagcgactaataaaaagaaacggagggagta

SEQ ID NO: 197 - DNA, 28 bp, Artificial Sequence
  Description of Artificial Sequence: Synthetic construct
acacgtgacacgtgacacgtgacacgtg

SEQ ID NO: 198 - DNA, 36 bp, Artificial Sequence
  Description of Artificial Sequence: Synthetic construct
ttatttattttatttattttatttattttatttatt

SEQ ID NO: 199 - DNA, 36 bp, Artificial Sequence
  Description of Artificial Sequence: Synthetic construct
aattttaattttaattttaattttaattttaatttt

SEQ ID NO: 200 - DNA, 36 bp, Artificial Sequence
  Description of Artificial Sequence: Synthetic construct
tctctttctctttctctttctctttctctttctctt

SEQ ID NO: 201 - DNA, 92 bp, Artificial Sequence
  Description of Artificial Sequence: Synthetic construct
attaaaaaaataaataagatattattaaaaaaataaataagatattattaaaaaaataaataagatattattaaaaaaataaataagatatt

SEQ ID NO: 202 - DNA, 92 bp, Artificial Sequence
  Description of Artificial Sequence: Synthetic construct
agatctaggagactgacatagattggaggagacattttgtataataagatctaggagactgacatagattggaggagacattttgtataata

SEQ ID NO: 203 - DNA, 8 bp, Artificial Sequence
  Description of Artificial Sequence: Synthetic construct
ctccdccd

SEQ ID NO: 204 - DNA, 9 bp, Artificial Sequence
  Description of Artificial Sequence: Synthetic construct
hkcmrmckm

SEQ ID NO: 205 - DNA, 11 bp, Artificial Sequence
  Description of Artificial Sequence: Synthetic construct
  modified_base (8)..(9): a, c, t or g
sacgtggnnvw

SEQ ID NO: 206 - DNA, 9 bp, Artificial Sequence
  Description of Artificial Sequence: Synthetic construct
araragarr

SEQ ID NO: 207 - DNA, 9 bp, Artificial Sequence
  Description of Artificial Sequence: Synthetic construct
cahcamcah

SEQ ID NO: 208 - DNA, 9 bp, Artificial Sequence
  Description of Artificial Sequence: Synthetic construct
raacccwar

SEQ ID NO: 209 - DNA, 8 bp, Artificial Sequence
  Description of Artificial Sequence: Synthetic construct
  modified_base (2)..(2): a, c, t or g
  modified_base (7)..(7): a, c, t or g
gnatatnc

SEQ ID NO: 210 - DNA, 9392 bp, Solanum lycopersicum
aataaacttttcaatcttaaaaaacgatctaaatcaaataaatcataaaattcaaatttattcataacctatttcctgatgttccactttttataattataagaatttaatagacaataacgtcttcatccattcaaattgcaattttagttcaaaattattgttacttcaattagttttagatctaggttcaactcaacatgtttatccttcaatgcaatattactggattcttaaaagttcagttcaaataattatcaaacaaatacattcgataaagtcaaattaattataagttgaattcaacattcacatgaatgaataaattaacaccacatgtttaataaagtctatttcaaaataaaatacaaatatctctcaaattgtaagcaaaatttcagttagcatattaatttaaatgagttcttataatctaaaatagaataaacacagctcaaacatcaatacgacagaagtatcatccacactctcttgaaggcaactgaagattgataaaataaataaatattatttttttaattgatctatttactattagttagtaaacatagttatcaacattaatacttgtatattttaagttaaaatatctatcttaatttctgtctctttcactagtttcttatccatcacttcattacgagtatttttaatataaataaataaattaagatgtatcctttaattattttagatttgtttcacttcttttaatattcatacgagaataatttatttttaaatacacgaaattttttaaaatcaaataaaataaaaagacaaagaacataagaaaaagaaaatgaaagaacaaaaggttaaaaaagcattaatttttttttcaaaaatattattttggtatttagatagaagaaaatactaaaataaattaaaatttgaccaaaatatagagttgaaagcggtgaaatatgaatttttggtagtattagaagtaaagagagaggggaaataaaaaagaaaaagaatatagttccgtaaaacaggcggtgaggagagagaatatgtttttaggaaaatagaaagaaaaagaggttcacagtttttgtacagcctcatccatcttctcgtctcttctcttctcttctcacctatcaccaaatcgcttcctcaatattccgagacccttttgcttagccttcttaatcggattctcctcatctttttttttcttacatacccccccttttcttttttcatcaacaaagatcaacgcaagattaccgtttttcttttttcttcttttcttctttttgctaggagtaaaccaagttgttgtagcttgtgtttgacagtaaattatgggattgaatggtgtggatcttacggatgacggcgacggaggaggaggagatgttggtggaggagaagataaggcatcggtggtttcgtgttcgatttgtcttgaagctgtaaccgacaatggggatagatcctggtcgaagcttcaatgtggacatcaatttcatcttggttagtttgtctaccaaaatatttttttttcgattaactaaacgtaattgacacttctttgtttcataagcaagcaaaaaacttgttactagttaaattcctctatggattgtctgagatctgattatccctaaagttgtggacttctctacttctattctttaaagaatggttggtaaattttatgcaatctcttaacttaaacaagggggtcgagcaggttttggtctaatttagaccacaattgcctagtagacactcatcctcgtgtatttgccaaaattgcgacagctgggtgatagaattgaatggacttcattagacgatgatgattattcccttcactaatcacttaggttagcagttccaaaacatggcattgcatgcgttagttgcctgggtgacttgggtgtgttttaaagcagctcagcggttgaagttgaaggtactgggtttcagcttagctaaattgaagaaataccaagaatgtctagacagtctaagcaattgtcaaacttgttctttgtccaatagaactctgttaaaaaaattacagtttcaaggatttagcagaattctgttagtaaaattaaaaattcaagtatgttataggagattgagtacttaataactttgtaaggaacaaggagcaagaaaagaggtggtcaatccataaagaaagaaaaaagaagttgattaatcaaaggttaaactgattattatgcctgtgtcataaagatgcagtctttaggcattacgatgctaaataaaagaaccttcaatcatacttctctgtttgggattgctcctgtccagttttgagtcttaaatctggggttaagtagctgtaacaatgatattattgcatgagaatgtagccagttctgtgatttttggatacgaagaaggtttcagatgaaaaccagaaaaactaacgcatcaactatgaaaatcatgggataaaaggtcttagtaatctctccttttgatatcaacaattattgttgttgaatgtattagggcgaagaagcaggggactatggagtgttgtaacgtatgcctatggcgttctttaataattttttaatgagaagaaaatgtgtgtatttcatcttgttgacaactcgcattctggcaattggtttgcagattgcattggttctgcctttaacatcaaggggcaaatgcagtgtcccaactgtcggaaaattgagaagggtcaatggctatatgcaagtggttgccgtcccctaccagatttcaacatggaagattgggcccatgatgaagacctatatgatctgagctacactgaaatggtaaatatgagtcatctcttacctactgttcagtaacttagacaatctaactcataaaaatatattaagagttctgatctatctggtttttatgcgggattcactggatgttcgtgttcctttttcttttccctgataaggaacattagggacattcctttatccggacatcataagtttcttgtggattttgaatgacgtggttctcctactgggaactgattgaagattattattgaagaagtagatagacatgcctcatctgacccataattgccttttcttatgttcttgtgcatatactttgtctgttttggattgcataactgcttcagtcatggtagctgtatccagtcacccaaacccgtactgttggttcattattttcttgttaacaataaatgaagttctttgagcgtagaactgttgatttggtattgcaagaaatctaaacaatccaagaaaaatatttttgatatatgagtttgcattcgctgactttgacaatttaggcttatataaacattattattaatacaaatggcctgttaaagtgttctcatggggtccttttttaagatgtcctgtctgaagtatttgtttgtgttaattttttgagatttgtgtcttagatatgtgatttgcctgcacatcttgtcggcctgggtttgtcttcacaatttccatgaagcaattaggataaatccatagcacgggatattctgatctttcacatttttaagaaagtcatctacaacaacttattgaaagtccaaatgtacactgcatttctgaataatttgcctaaagaattgcatcaggttacgaggtttgttagaccacataagttttaggatttgtcgacaaaggggctccatatttttgtccatcataattgctgattctatcttatcatgaacatccacttgagaacacattgcctgttagtgtggtaactgtgttaaatgcatagcaactgcgacatatgcactggctgctagaaagttggatgtggggacttcccgtttttgaatgtagttgtcaattatttttaggagcaagaaactactgcaaatggcgtgtgtgaagttccatttctcctgtgcttctacaaaaaaagaatctcaatttctcccaggtcctgtcaattgcaatagagaacattaaaaagaaaattcctgttcggctcatgaacatttgttattgcattaatattgcctaaatgtagctttcgcttttctgttggcgtccttttcttttgtgatctgctgattgttgattgcatttgttttcaagccaaatataaattttacttactgaatactttatttcctgtgcgtggttttgcagtcatttggagttcactggtgtccgtttagtggattgactcgactaccagcatcttttgagtaagaacgatatactctgaatttttcttttttactttgccttctttgggccgagcatatcagttttactttttgggttgagattgatagtctttttaaccctcttgtggttttgttactgataaggctgcctcattaggggagcttgtaatcttgaactgtccctacaacaacatacccaatgtgttcccacaagtggggcaattttgaaatgtcactgttctgcttatatagtctttgaaagagaatactgatatcctttatgtgatttgtttggatttctgttagacttgttaatggagaaggtcaattacccttgtcataaaatattgaggtagatttggccatttggtggaaaaagatatacttggaagaaatgcgttggtgtgtgtgtatacagatgagatactggcgatatcatgaaatagttcatcagttccccttacatagttgaagggaaaatacatttgctttcttgcttctgtacataagcactatgcaagtgctgtcttatttaccttgtgaagagagataaagagagaggatactgttttcatatacatatatataacgacatgtcaatgaaatttgcttctccaaaaaaaaggtataaaaacaaagttgcttctccccatcttgctaaatatattaccagcagaaggatagcaggtctggtagtgtcctctggggttgggggtaagaccaggatgattttttacctaataagaactgagagccacatattttctttaccttttgaattttgagttgagtttgaattcatctctttctatgctatattgaggctgagttttgagttaagtttgactacattgtgtgaggtggaagtagttcattcatagagcattttacatcttcctagatctgaacacaggcctatttagctagtttgagttcaggatgttgatgggtttgctgttggactaattgcctcaagcatccaagtcgctcactgtttgcagaggccttgaagtatgatatgcctttaggttgttgctttcttttttgatgagcaaagagttgagattatcatttctttttttgcctcatgtgattctagcaaattttacgtgagtcaggataaggaatataagttattagatttcagcatcaattcaagtggatcaagcttctacgctgaccattcaaaaggcctatatacaacatacccagtgtaatcctacaaatggggtctgatgttagtgcatgatttaagagaaaaagaagattgaagtcttttaattttctcaataaaataagtaaaaaattctcaaaaaaagattgaagtctcttaactattagttagcatatcagagtgaacaaagtaggcactgatgatgttctgctctttcactgagttgttcccataactctgcagttggcacatttctatagattgttgtccctagaattggctgcaatctgtctctagactgaagcttggaattgtacctccataatattcccttaaaggaggattcaccttggacctttgaggcttatataccactgctacaagctccttggccaatgtgttttgtacttccactattagaactgtttcatttggacaattactgttattagggtttgcaattggttgatcgacatgcattgaagcttttcttagatgggcttgtgtaacattcccctcggttttgatgatgttttcgacaccattgtacttgtaatattattttatacaactgcttgcggattccaaattgaattgatttagtaatcaaatttgaactttgatgtgatgattactcttatcaagctacttgtgttaatttaatttcttcattaatgttctttcggctaccacttgtacttacatcatgaacatgtgaaatcaacatttttaagtctttctgccgtatcacatgggttggagagtatacataggataatattccatgtgacattagagttcaactgcggatgcttatacttcctgttctatgcctgcttgccaatcggtgagcaaactttatgtgcctgcccttgagttcccttttatttacacagaagaaaataaagggtagctatgagctaatgatgagaataattcctcaactttcttgctgttgatggagtaaggtttttctcccctcttttcttgctttcactgtgctgtagattttgcttgttgtgtcatgcctaggccccctttgcttctcttcatttattttctagtaatatataattcatctgaccactgcatttcacttgcctacagcgaaggggagctttcatctagtgcatgtaagatttctgactctctgtcttgctgtgtagtacctcttttttgtcaagcttcaataatgagagagtttctgttacttcttctgtagatcatgatcttcttggtcagcatgctatatttgctgatcacacagctgtatcatctgctgctcatccatgcccgtatattgcctatgttggaattcacccatcatcctcaaattcgagtggaagtatcaatgatggtcctaatttcaacaatcactggactagtccatctgttcccaacgagatacctgcttcttatgctttcccaggaatggatgtgcattatcatagttgggatcatcattcttctttccctatggcaagcagtcgtgttggtactgctgatcagtcctcggttccctctgttactcagagagttgccaggaccaatgctgatatcccaagaccaggatcttttgtccctccattccttgttggtcacgggtatgatatgtgtaatcgaaggcaaaaaatttgtttctgattaaataattatcaaattctgataaatatgggttctagtttgtacctcacaaaaaaaaagttcctcctacattcctttacctttttattctgtttggatgagaggatacgtgaaggaatgagggctttaaagtacagggcctaaaatgtaagaagaagactgggtatatagagtttgaaggaaatattgaaaaaaaacttcgagtttttttttagaatttaatttactcctgctttaagataacttgaatcaagtcattatgtggtgctacttttggaaaatccaaagcgatcaaagtttgtttgttaactgttgtttttgccttctatatgttttcctcaactacttgggagtggggaggcatgttgtttttgtactgatattcagattgtgatgttcattgcttttgcagttctgctgccagagctggaagttcagttgcttcaccaatgatacctccttatcctggaagtgtagctcgggctcgtgaccgtgttcaagctcttcaagcctattttcagcaaccaagtaattcaccagctgtacgcactcctgttatgtctgctactcgacgatccaacaatcacagagggttggctcaagtggggccggctgcctcatcatctgatcaggctggtggcttctacttctatccttcaagttcttcaggaagaaatttccaagaagcagaaaatccagtatcaaacagatatcacgcttgggaacgagaacacttgcccgccttccccttgagtcaggttgacagagatcctatttgggggccatttcatcacacaggtgttggatctgatagtggtagccgagctggcagcttccgaccgagacatgggtctgagaggatgccgtcccagaaccggtcatgaacttctgtgctgttttgatgagaactgtgattactttgaatgaacccaatttatgtatgttttgagaaaacgatctaaaatggttggagtcttgtcaatttggcaggttcaaaactgtttcgtggccatgaaaagtgatccctttctgatggccatgagttgtgtgatgggaccgtggcgctctcttgtttctgtgctgtggggtataaataacatcacaatgttaatggcaaagttcaagctagtgatttgcctctttatctgcagtgcttggttacccatatttctgtcatattagtaaatggtttgaacattgatgaacctgttgaatgtagttttggtcaacagaacctgttgttcagattggttctacggttgaagcaaccactgcatcctttatgggtgacaaagaattaaagctattagactgttttaagtatctaatatttagtgataatggatctgtggtgcatatagaatgaaataatgcttatttatcacaagtcttttctgggaagagccaaacataagaaaaataataatgttcaattatgtctaggcttatgctgtgatgattttccacgaacactgtttcaaccttgtggcattgcaaatcttattgctcctaactacatttggtacatgaaaacatagacctcagaaattgataatttcatgagcatcagcgtacttttgttaagtaattttatcttgttaattttttactactggcattttgtttaaaactaaaaattcttagttgaaagatttgacatgatccaaaataagaaaagagatattaattgaagacatgcattagtctcccagtttactgtgaaatatcgttgcacaatatgagtgaactcgtatgttaaaaagtctgaaggaaatcgtaattttgcttaggctacattggaaacttcaccagatgatgaacttgtaaaatttgaataaaaagataatagtgatccgttaatccataagatgtgaagagaatgaagctacatagaataatggagaacaacgctatatattcagtgagccacaaagaaaaaatctgagtctcatatgcccaggcacatccaaatctgaatctaaagaaatattgtggaatcccaaaacattcaaattgggtaaatctaagtatagagggtcttgttccaatgtgaaaaaaatctttttaaaaggcatggcaaaagaggaccgagaatcataaggcgaatgccaaaagtcccccacagacacacatgataaaggggttttaccctaacacagacataatgtcacgacccaaattcgggccgcgactggcacccacacttaccctcctatgtgagcgaaccaaccaatctaaaccttaacatttcaatataatatcaacagaaagtaatgcggagacttaaactcattaataaaatcaataactattattatccccaaaatctggaagtcatcaccacaagaacat

SEQ ID NO: 211 - DNA, 6011 bp, Solanum lycopersicum
ctttgaaaagacgtgtactctaaagaaggaacatatatatgggagtgggccacattccaaccttcaacagagtaaatattctttcatatcatcttaacaaaaattcacgttcataaatatataagcgtaatttaaaatatatatatcaattttcatttcaaattatatgaaaatgacattaattttaaaacggaacgtgatcacccactttttctagtttctcccttttcatcacgccatcaattctctttctggccgtcgttgtaattttgcaacttttcttcctgccaccacctattttgaatttatttttatcaaaataaaacaagaaacaaatatgtactgtcccaattattatttgaaatagtcgaatagtttttaaaacttttttttctgatatgagtttttttaaaaaaatattaaagataaaattttgaaaataaatagtatttaatagaaaaataaaataagtttaatttttttaatttaaagtaaaattatgtttaacaaattgaaacaataagatagaatgagggagtattaactaactatggagatgcttaaattaacaaactcaactaattaagaggcgcgggaaaaagtagttaagtatgaaaataacattattgttattggttcacccattcacctttttaggtgtttttcgaggtcgaatagtcatattagaatcgaattaaattacatttttaagtatgttttaaatttttttcttcatatttcaatagagtgaaagaagtttaatcatggataataactcattagttcactttttttacaatttctgaagcccatactaaaatttcgattaaatttaaattacactttacacgattcatttcagagtgcaattttcaaaatataggcgaattcattttctctgcctctttttccttattttaattaaaataaacaaaacaggaccaaaaaaactaaaataaaaaacagagaatgacactttcactttattgtatatcatcagtattcatatgatatagtacagtgaacacatgactaaagccttcacaaatacaacaacacaagctaaaggcaaaatcacccataatcctcctcctccagcaccacctagtactgctactaatcgttttttctattcagctataggagctaatagcttcagcatttagtaataatcaatcaattttctgccgcagaaatcactgtgttgtccactgtgttaaagaagagaagaagtgtgtagctggagctctagttaagttttattttttttggcattccaagggcttgagagagtaaagaaaacgacccagctgaagatttttttcagatctcttgcttaactggtaaaattctgctttcttgatttgtttgttgttctgtaatgtggttgtcgtttttttttttgggttttttagtctctctgttattcttagcatttttgtgtctatgttctggaaaaaaaaaagattcccagtaatttatagtggccatattgaattctttatcacccataactgaagctagatctgcccatggttctttcttgtatatttccatgttggtgagtgttaaaaaaaatagtgaaatgtgatgggggtgtgaagtgggggggggggggtttcttagaagttgattgtcactcactttgggattaaaggttttatattcagagcttgttgagggttatttcatactgttattaatggaacttgtggaaattatggaatgttgaggtgattgtaaaaataatatttgcctaattgggtgtttttgtattacatcatgcatgtctctttataaagttcctttgttacttaccatatctgaagatcttatagtgactaattgagattgtgttggtgaaaaataaccttttgttatagtgactgtttaatgagatgttagtttctttgatgtgtttgcatacttgtcatcaaaatggtcttagtatacttgattagtggtatagtaaagtgtggggaggcggtactgattttttgcgtttctgcagagttttcttctggggatgtacttgtgatgatacatatagtatttggagatggaaaggatacctgaagttagagaatcaactaggcagtttcctataggggctaaggtggctcatactttctcaacctccaagaaggaggtcggtattagaggctttcgagattttgacttggctattccaatacaaacatggaaaggaaagacctcctatcaggaggaagaagacctgatggtcgatgctggtacaatcaagcgtagtgatgattcacttgaagatagtggctctacatcatttcatggggcgagtcatcctccggaacctgttgatacagacctaatgagaccagtgtatgtaccaattggtcaaaacaaagcagatgggaaatgtctggtgaaaaacgtatctttgaagggtcctttcttggacgatctttcaatccggatgccaaatgtgaaaccaagcccatcccttctttcaccggcagagagcttggttgaagagccaaatgatctaggtgtaatctcctctccatttacagttcctcgtccttctcaaaacacagaaaccagtctgcctcctgattccgaagagaaagaatgtatttgggatgcatcactgcctccaagcggaaatgtgagtccacttagtagcattgatagtactggtgttgtgagatctatgagtattgtcaacagttgcacaagcacgtacaggagtgatgtgcttatgagtgatggcatgcttagtgtggacagaaactatgagagcacgaaagggagcattcgaggggattcactcgaaagtggtaaaactagccttagcagagcaagtgacagtagtggacttagtgatgatagtaattggagtaacatcactggcagtgccaataagcctcacaaaggaaatgatcctagatggaaggctattctcgcaattcgggcacgtgatggtatattaggcatgagccactttaagttactcaaaagacttggttgtggagacattggaagtgtttatctttctgagcttagcgggactcgctgctattttgcaatgaaagtgatggataaggcatcacttgcaagcaggaagaaattgacgcgtgctcagacagaaagagaaatcctacagttattagaccatccattcttgccaacattgtacactcattttgagaccgatcgcttctcatgtttggtcatggaatattgtcctggaggagatctgcatactctacgacagcgacaacctgggaagcatttttcagaatatgctgcaaggtatggaattgttatccttatctagagtatacaacaggtatatattaagcaaagaaaaacaggtagataatccttcttataaaaggctttcacatgtagtcctaacataagcacaataaacctctggtcactttaacattccttaatccttatatggtattaactctctttttcctaagtgaattctttatctgccactaaatgcacctttactggcttacaaagggctatttcttttccctttcctctttttcttgagtgggttggtgttggcggatagagggtgtattggtggaaggagatgatttttgccacaatgaatgtcaccccttttcacgtatccaaaaaaacaaaaagatcgtttccaatttttgcgtactggcaaatagagaatgtcgaatatctgataaaatccttgaactatgttttacaagagaagttatgttgaagcagtgatttaagcttccaaagagctcagattgttcactgtcttttctgtactaggtataaattttgtccctgttgtgtccctgcctgttttttttcttcaaatctggtgtaagaatgttagagcttgcctagcttgacatctaagtatgtgtcattagattatatcctttatcattatcatctctagttcatgttacttgatatttgtattcgaaagctgaatagacttcattttgatctccctaaaataaagagactattctagttcgctctggtgtgaggatcatagaactttagtttctagattggcactaaaaaaagttcagaattttttgcatttatgtttaaattttgagttctttaatcaaactttaactaaccccccggtttctgccacaggttttatgcagcagaagttctattggcgcttgaatatctacatatgcttggtgtagtgtacagggatttaaaacctgaaaatgttcttgtgcgtgacgatggccacattatgctttcagattttgacctctccttgagatgtgcagtttcacctacgctcataaggatctcatctgatgatccttctaaacgaggagctgcattttgtgtgcagccagcctgtattgagcccacaactgtatgcatgcagccagcatgctttcttccacgtttatttcctcaaaagagcaagaaaaaaacacctaagcctcgagctgattctgggtttcaagctaattcaatgcctgagctagttgcggaacctacttcagcacggtcaatgtcatttgttgggactcatgaatatttggcccccgagattatcaagggagaaggccatggcagtgcagttgactggtggacatttggtattttccttcatgaactactctatggaaagacccctttcaagggatcaggaaacagggcaactcttttcaatgtagttggccaacaacttaaatttccagattctcctgcaaccagttatgccagccgtgatctgatacgtggcttgcttgttaaagagcctcaaaaccggcttggggtgaaacgaggagcaactgagatcaagcaacatcctttctttgaaggtgttaattgggctctaatacgttgcagtacaccacctgaagtgccaagacccgtggagccagactaccctgcgaagtacgggcaagtgaaccctgttggggttggcaataccagtaaaagagtggtaggggcagatgcaaagtctgggggtaaatatcttgactttgagttcttttagttttaggaaataggattcttgtatcagtaatataacattagttgatccttcagcagtcagcactgctttcttctagttattatcatttgttcaattgatgaactgcaatacacaagaactgggaaaaactcactggccagtgggttgtgtgagaaaggtgaaacaaaatgccttgttatttccatgtcttaggagctagccaaagactataatgaagaagcatttggatatataatactccctccgtacttatttacgcgagtctcgttatatttagttcttccaaataagatactaataatacacaatagataatgcatgatgtactccacagaacgatctcatagatatatctattgcaacgattatgttcatcggtataagcactctactgaacgatctcatagatatatctattgcaatgattatgttcatcggtacaatgtgtagttttttataatagcaataaccaataactacgacaacaattatatcaggtgtaaattggaaaagataaattatatacaaactttattcttatctcggtagagaggttatattcgaaagatctacttcaatttgcctaaaattcttaggagttatttggtatgtgggatgggataaacaaaaattttttatgacttgaagtactccgtgagtttatttaatccactttttttatgagatattaatcccgtcattttaatataaataatgagataaactatttcaaaattaattaatatcctaaactaaatatgaaataaagtttttttcaaattttattattctcacgcacataccaaagattaaaagtttttttgattattttttttaattacgtgtaaaatcaattttttataatttaaacacccgcccaattattacatgtatatacaaatttagacaactattcagtacatgaagtgatatatagtttttcttacaattaatccccaaattaacactgtaccctaaaacttcctccggcatcgaccac

SEQ ID NO: 212 - DNA, 6938 bp, Solanum lycopersicum
tgcatatgcatttccacacattaaaaaggaggatattgaacaaattaaaagatcccaaaatgtacatcaaacattggaataacaaaaaagagcaatcaaatcaaaatataataattttatttaactaatctaagtcaataacctatgttatagacttattagattctttggttagtgcaaaatgacacaattaatcaatcaaactacactatatatgtggaaattaaatagctatcgtgtcaaatatattcataaggcatgataattaatccattagattatccttcttctaaatcttatctatagcatacaaacaaattataatgtctattaaaaacgtaaataaattttttcgccataaaatataacgacaacgatttataaagaaaaaaatactatacatgcccaataaaatatttaggttgtgaaaattatgataatttcttccatcagtataattatcatgatttttataaaaattcactttctatcagcaaaattcgtaaatttcttaaactagaatttcatactccgtcgcaattcttataaaatttgctctcattcaaaaaaattcacgaatttcttaaattaatatttatgctcatttgtgatttatatacattttatttttagaaaaaattcgtaaatttcttaaaccagtatttaattctaaaatactaaaaagtcaaatagttatattacaactttgctatacggtgggtagtggaaatcaatcaaaaaaatctaaatattgatttccgcggaactaatttattatattataaattatttagtgatttagtcaaactcaaaaggtgcaaaacgagtttcattattaattatatataataaaatataaataatataataatgcttcaattaaactttatagtaaaaaaaaaggggggaattaataataattgttttctttattttcctcacactatataaagcactaccacttcaataaatatatcttcactacacttctttctcactctaagcatctctttctctctctataacactcacaaaatccatatttacacaacaaaaaaaatttaagtttgatggataaattaatcaatcaagaaaataatattgataaagaaattatggagcttagaagaggtccatggactgttgaagaagatttagttcttatgaattatatttctcatcacggtgaaggtcgttggaattcactctcacgttgtgctggtaagtaaataattatttaatatatttttactaattgcaacatgcatgtcacttactatgtagtattttctttcatctcaattatcatattttttgttttagtctttcttaaaaattaacgtattaattaaacaggtttgaagaggacaggaaaaagttgcaggctaagatggcttaattatcttcgaccagatgttcgacatggaaatattacgcttgaagaacaactcttgattcttcaacttcattctcgttggggcaataggtatgttctttaatttgttaaatagatgacgtaaaagaatttttacactattcaaattatttcttatagattaaacacaaggaatatcacctttttatgaaagattactatagttatatcattactagacaacttaataattaatgtaatgtctattgatcatatagcactttcctattcaaccaatgtgagtttattatgttttctttttgttgttgttggtgtataggtggtcaaaaatcgcgcaacatttgccagggagaactgataacgagatcaaaaattattggagaactcgggttcaaaaacatgcgaaacaactaaaatgcgatgtgaatagcaaacaattccaagatacattacgttatctttggattccaagactagttgagaggattgaagcatccaaaatttcgaattataattgtattaacgaagctcaacaatccattatgagaacagatattaataataattttagcactagcgttacactagaaaattccagcgtggcaacttcatcagaaaactctaatcaagattataatcaagttaatcaaagtgatcaattatggtatgaagattatcaagcaatggaacaacaaaataatatagaattatggatggataatgaagatgttttcaacaatttgtgcaacaatgaagacatttggtccttattagagcattaaattaaattaaatcaacaacaggtatcaggttcgagtccccttgggtacagaatcgtctttattaggggtatcaggttcgagtccccttgggtatagaatcgcctttattagggtacaaaatcacctttattaggggtatcaggttcgagtccccttggatacagaatcacctttattagggagcgttttactcaatgtgagatttctcgtcgtgaatctgaatttagtcggactagaaaaaaaaagtttgagttttggcaattttttagagttataattaataagcattaaacaaagcatagaacaattttatcttttttttttttaattgtgtgtcattatttgtaacatttcaattaccagtagatgataataattatattgttaacttgttttcttcaagattttaatcgtccttcaaagttgattactcaaagttccaacacatggattattttttttttcgatattaaaaatcgataacatagttaatttgttgactttcaacttgaagatcataaaaacggataatatcctaaatactttgatcaaagagtttacgaaatatatataaatgtattggttttgacatatactgttcgaactatttttgctttttttgaactatgagcaaatagcttacgtgtgagaagcaaattaacaaagttcatgtaccttaaacttataaaggttcaattaacaatatttgttaattagtttaaagaaacctacttgctagattaatctcttaattaattaattaattaactaataagaattattacttaaagcttgcttatttgactagttaactcataaacatggtcaactaaaaatatgagatgtctttgactctatagagtagtacttaggtttatagggttttgaaagttgaaatattaaatcaatacaaattaaaaaatttagagagaaaaaaaatgaggacattaagaagtgttaatttacatagtggcttacgttgctaattaaatttatataaattgttaagtacaagttgagtaaagatgtaataatgcttagagaatttatagacgatatgatgttgttgctcgtcatgatttaaatgtatcatataatatattatctgtttttacataacaaatcttaaatattttttctttttgggctatgttgttgatgtcggatcaaaaaatacgtgtatttatccgttttttcgtgtgatatgtcctcttcaattcgtcctttatcatggttatatcatcataaatattgaattcaaattttttttttaaaaaaaaggaaaagataggttaacatatattcgtaaaactaaatttatatagttataaataaatgaaaaataaaaatatatagaagattcatatatgtaaattaattattagcagccgtaaagtgacatgtgtaggaggagaagcattagattaaaatagaaaaatgtcattatattagcactaattaatagtaattaactaataattaatcttgttggtgccattggcaaacaaaaaaacaaaagataattctctcttccttcgatatatatgtatattcatacgatagtattaaaaaaagactcgtacaaaaaattcaaaaaaaaattatcgccttatttctttggtgcgttaaaaaaaaattatttagatagagacgacaaaatcaagaaagaatcagaggtaatacagtcaattaacttgacaaagacttttggctatgaaaaaaataaataaagaaaatatcataaaacgtacatatttacttaataagtatatattacattaacaattacgactacaaataattttttacatcatcgaatgataaatcgaaaattcaaaggtgctacattgatatatatcaagacagaaaccaaaaatagaaaagtgaaacttaatgctttcttcccaaaaagaaaaaaataattacattggatatgacaaatcataggataagaaaatattattgttagggatttgacaaatcatatattaatggaaaattttgatttgattgatttggaaaaatcaattctatctttttaattgaaggtggacctagaatttttattttatcaattattaattacgttatacgtctattattttaaaaagttacaataaaattcaagttaagtatactgataaagtataactaatgtatattttttgcaaaaaaaaatttaaaaaaatgattggacaataacttaggatcgtaatatagtgtatattttttttatatttgttgtcaattaagccgtccttataatttaatattattaactaaataacacacttgatcatattcaaatctaaaattaactcatgagataatcaaaattgcccaaaactctaaaaaaaaaagaaaagacataccatccatcttcgatgatgttaaattaagatgaatctgacttagtacttatcgattttaattatgcgataattttcaccaatatcactaaatggtaaatcttgatatatggattataacattactacatgaaatcagaaagtcaaaattcatgactatttggctacatagttgaatgagtccactatgtagaatgaagggaaattaattttattatatagtcaaaaccaaaaggtgcaaaacgagtcgtatcatcatatactatgcttaaattaaactttatattaataaaaaaaatgggaattaaaaaatagaattattttttaatcattccctcacactatatataaagctccacaactccctctatctccaaaatacatctattcacaacaactattttgtctttctctctctatatataacattagcaaaaatccaataattttttttatatatatttttattttatcaatcaattttgatggataaattaattaatcaagaaaattatattgatgaagaaatcatggagcttagaagaggtccatggactgtcgaagaagattttattcttatgaattatatttctcaccatggtgaaggtcgttggaactccctctcacgttgtgctggtaagtaaataattcattgacgtatttccactatgaatatgtattttttctgttttagtctatccataaattaacgttttgattacttaaacaggtttaaagaggacaggaaaaagctgtcgactaagatggcttaattatcttagaccaaatattcgacatggaaatattacacttgaagaacaacttttaattcttcaacttcattttcgttggggcaataggtattaattttattttaaaaaaatatatttttatgtttagaattttttacaatagcatatataagtttcaaatatcttacaactatataattttgtgagcgtaggtggtcaaaaattgcggaacatttgccaggaagaacggataatgagattaaaaattactggagaactcgagttcaaaaacatgcgaaacaactaaagtgcgatgtgaatagcaaacaattcaaagatacattacgttatctttggattccaagactagttgagaggattgaagcatccaaaatttcgaataataattgtattaacgaagctcaacgatccgttacgagcactagcgttacactagaaaattccagcgtggcaacttcatcagaaaactctaatcaagattataatcaagttaatcaaagtgatcaattatggtatgaagattatcaagcaatggatcaacaaaataatatagaattatggatggataatgaagatgtttttaacaatttgtgcaacattgaagacatttggtcctaattagaaagtagtaattaaattaaatcaacaactatgtttgagtttttgtatttctttttttttttagagtataatcaacaattgtaagaaatcatagaacatttttatcttattatttgtcatttaattacaagttattaaagtacacttacaagttcaaaatagcctctctctttttttttccatttatttaagcgttagcagagcggtgatcataaaataattttcttttcattctcaaagcttaacctcaaacctttaattaagggcgtgagaattttaatcatcgtgccacaactcatgtcgttgaaaaaagagccttatatgattgaaaacaattggaaaaaatagttccaaatgtaataatctttgtttacatatattttcatagttataattaggtttcagtgcaatttaaacacttccaacactttgccatgatcttatcttttagtttaattcaaataatgtaacttaatttctcagtaacgtcaactcaaggaagattcgaggggcgttcagccaaggagaggaggctttccgctgcaccataacactagttgttgaccatcgatttctttctcctaataacaaaaaggcgagtttaaggtttatacaacataacaataaatatatatactcaatgtaatttcattaatagagtcttaaaaaaataatatgtaattatatgtacgttgactatatccttatctttatcttaaaagatagaaaaaattatttcgataaattaatatatatacacatatagtgtaaaaagtattaagatttagtacatgcatgtgcatatatgaagtattattacctatgtatttttatttaatataattttctatatacaccgtataaattccgatgaagtacaattaaataattgtctttcattatattgttacgcaactgattaaatcctaaatttattatcatagtctaaattctaattcatctttggtgttgaccattttatttgactcttaacaat

SEQ ID NO: 213 - DNA, 3615 bp, Solanum lycopersicum
tattagtcgaattataatattttgtattaataataaataaattaagtaatttttattttagaaacaaaaaactatatctaaataataaaatttataagctaatttatttaaataactttattagtataaatataagatataaaatataaaatcaaaaaaataaataaaatattaaaaggatttgaagggtatttttgtctttacctagaatagtctcatggtattagagttaatacctccaaatgaaaggtattagtaatacatcacataataccatgtaggatgtattaactaattcatggattagttatacataggctgacattcctaccaaacgcaatattaaattatatcacatctaatacaagaattatttcttttaatacagactaccaaacgccccctaaatgataatataattgtctcacaaaatcacctaatctatcttatctttacgatatatgtttccgtggctgataactaataaacatgattctcaattgatgaaatgaaacaccaattaaatatagttacgtcaaataaagaagttatgagaaaataaaatctaaaagaaaacaaaattaaaacttacttaaaatgatgaaaatgaaagagaaaccaaatatgtgttatgaaatagtggtaatactatttcatttttaattaataatattaaatttgaatatcaaatataaataaaatgctattttaaataaatcttataatatgctatacaatttaatttatcagtacggaaataaaaagagagtgtcccaagggttgaagaatagctaatagggggacatgggctaatttggatctttttgattaaaaaaaagtgcaatttattacaagtgtcattttgtggaaagctcccttagtggttacaagttcttccacgtatgtcgaagggtttaactttttgtatatatagagacaggaatggtgtagtattataattaaaatatatgtattaaaactatatattatagaaaaaataatgaatactcctatgtgtgcatcgttgggagttaggaaaggttcatggactgaacaagaagattctcttttaagagattgcattcaaaaatatggtgaaggaaagtggcatcttgttcctgctagagctggtattacttttgtactttttctaatttgttttaaaaaataatgtattttatatatttataaatgatttactaaattctaagttttgattttactttctaataacataatttatagttttatgatttgttttaaatcataaatttttgtaatattttatatttatttattaattttgaatgttatgtgaacatgtataggtttaaatcgatgtcgaaagagttgcagactaaggtggctaaactatctaaggccacatatcaagagaggtgactttgctccagatgaagtggatctcatcttgagacttcacaaactcttaggcaataggtaagtctatgctgcaattatttcattcaaaagtttttgatgttatatttttttttatattgtattggtcaaatatataagtagatttttaaatttgttggatttttttcctcagatatttcaattacgtcatttttctgtataatcattgaactcccataatttgttccatttaaacaatcatcgttgtctgatgtggatcaagatttgtgagggtattgtttcacaaatcatagtccaattgatagtgaaaatgtttgagaataattgtgttttactgaagtcattttgaacacattagaaaacaaatgagactagcacggtttgtcttcattccttctatcaaaattattacaactcaaacacaatcgaagacatttacaatagaaaagctgatcaaaagtgttttaaaaaaacaaattatgggtggttcaatgattcaattgaaaaatgacgtaattgaggtacctgagaaaaaaaaacctaaacatatgtgtaattatttcatttaaaagttagttattttgtataggtggtcacttattgctggtagacttccaggaaggacagcaaacgatgtgaagaactattggaatacacactttcacaagaagttaagtattattgctcctcatctacatcctcattctcgtcctcgttctcatcctcgtctacagattaagcataagagcatcgcggttactaagaatgaaataataagacctcaacctcggaacttctcaaacgttaagaagaatgattctcattggtgcaacaacaaaagtatgatcacaaacacattagacaaagatgacaaacgttgcaacgaaatcgttgtaaatatttgtgagaagccaataggagaaaatacatcgtcgatagacgatggagttgaatggtggacaaatttactggaaaattgcattgaaattgaagaagaaacagctaatacaaattttggaaaaacaccaacaatgttgttacatgaggaaatatcaccaccgttagttaatggtgaagacaactccatgcaacaaggaccaactaataattgggatgacttttcaactgatattgacttatggaatctacttaattaaagaatttttatttttgtcgacgtttgatatttatattagagtccaactgaatttaaatttacagattcatacaatgggtgtgtcaaactcaacctctctccttaatcctaattaaggagtacttattactatgacatatccttagttggtattaaagaatatgtaatgataaattaatattattgtataacttataatagggatacaatatagttgtcctttatactttgtatcctaattataagttgttaggaatgtaattttaaatattttagaattattgtaagtgcatgcactctatttttatattttatgtgatttttaggataagcataaatatcaaaaagttaaaaaagatttagatagaattgggttgattcggttcaaattttatattgcaatatcgtggagtcttgaatactccgtcattcttaattagagctctcatatttaagcttcttgtgcttgaagtcgtatttattaggaagcacactagtccctaatatgatactttttaaagcgaacccaaatttaatcaaattttaatataaatcacgaacgacctcaaatgacaagccaaaatacatgaacaaataaatagttaaaaagtttaattgatgagttcttcattagaatctcttttactaaataatatccgaataaaaaaaaatatcttatataaatttttaaatataatagaaaaaattattgatttttcccatgtcaggtcataacactcgctgtcggtgaaacttagaaatgtggtttcgtaaactttgaaaagaaaaacaattacttgaattattttacatgagatcatttcaaatatactgtacgtcaattttaataaccttcaactaataaatatctattgtttataatcgaaggaaatgacatatttaaattattaaattattatttcctatgtcttatttatattatgattattttaaatatttttagttattttaagaaagaagaatatattttttatatacaattagcaataaataatttagatgatataattttttaaaataattagtatatttaaaaa

SEQ ID NO: 214 - DNA, 4380 bp, Solanum lycopersicum
ttatatcataaaactaaattactcatttttctttttttttccttctctattttcaggtataaaccaatgaatttgctattataactttataaacattacatttttctttccttctttttctttataaactaattgaattccttatatacttatgagtcttaagtaaaagaaggaactcacacaataatagagggtatttatattgatttggtagtaatttaatcattatttcaaatttttatttaaaaaatcaataaaatcactacactttcatttctgcccaccatttaaatagttactatacaactatgagtgctaaattgcattcaaattattattttatattttttcctttcaatgacgtcgattcattatgtttagcgtctctaattcaaagtcgaatatgaaattttttatttcattcggctcctttatggagataagtcgatagtatttactagcaacaacataataaagacaattactcaatatatattttttgatgatcaatatatatatatatatatatcagtaattattattgttaactaacaataaatttaaataatataatataataaaatttataaattatttatattttattaatgagaaggaaataaggaatatcctgtggatgatcatcatgtagaccccatctacacaccacatttttagtcaaatttcttcgttaaaaatttcagaatcccactagctcctatagcaactatttttttctttcaagtctaagtcacctctatatgaaacttcattgctctttcttttcagaatcctagaaaatttccaattaaaatagaccttagacaaattacttttttattataaaaaaacacaaacaaaaagaaaaaacgagtatattaccaactcccatgttgtcttagtcaaaataacctgccatatttgattgaccaagccattaagaaactactatatatatatatataaattagatccacaaacaaatcatcttagaccaaaaaaaagatcaaagcaaaataacgaagtcataattttgttattcaagttcaatccaacatggttgagcatgattttcatcaacaaactcaaagtttagttaagttggtggtacttgtatgtttgttatttctatctgctagtatttcagttgaagcgcgaattcgtcattatcaatgggaagttaaatatgaatataaatccccagattgtttcaaaaaactctctattagcatcaatggtaaaactccaggacctactattgttgctcaacaaggtgacactgttgttgttgaagttaaaaatagcttgttaactgaaaatcttgctattcattggcatggaattagacaggtaaattatacatccaaaaataaaataaaaatccctatgtttttttttttttatcaattttttaattttatatatgttgtaaatattgtagattggaacaccatgggctgatggaacagaaggagtgacacaatgtcctattgtgccaggggatacttttatatacaaatttgttgttgatagggtaaggttttttttcttttcttttcccctaaattgcatttaatcgaaacaacagtacgattataatgaaatgtgtttaatttgtgcaggctggaacatatttgtaccatgctcattatggtatgcaaagacaagcaggactacaaggaatgatgagagtatcattacctgatggagttttagagccattttcatatgatcatgataggagtattcttctcactgattggtaccacaagagcacttatgaacaagcaactggtcttgcttcattgcctttttcttgggttggagaacctcaggtaaaaaatactatatgtacaacttatttcaattcgtttgtcttattttgacttaacatggaatttttaatttgtttcttttttttcagtcaatcttgattcatggaagaggaagattcaattgttctattccgaccatagatcctactctttgtaatgctacaaatcctcaatgtacaccttattcaatgactgtggttcctggcaagacttataggcttagaattggcagcttgactgctctttcagctctaagttttgaaattgaggtatttttcacaatgacaacctaacatgcccgactctccaaaattgttaatgcacactacttttggaggatcagagtcggagcatctcaacaatttaacttaataaacaagtttgtttctttttttttattgatcccatatttttgtgatgcaggggcataacatgacagttgttgaggcagacggtcactatgtggagccatttgtggtaaaaaatctgttcatttattctggagaaacatactcagtcctaattaaagctgatcaagaccctacaagaaattattgggcaagtacaaaagttgtcagcaggaataatactactccaaatggtttgggtattttcaattattacccaaaccatcctaggagatatcctcctactgtaccaccctcggggccacgttgggatgacgttgcccccaggatggctcagagtgttgctatcaagtcccacagagatttcatccatgcccctcctctgacatcggacagggtcatagtcatgctcaacacacaaaatagggtgaacgggtatgtacgttggtcagtcaacaacgtctcattcaacatgccccatacgccttacctgatcgcccttaaacacaacttgttacatgctttcgagcaaacccctcctccggacaactatgaccaaaagaattacgacatcttcaatatcgcgccaaatgtgaatgctacaactagcaactcgatttatcgattgaagttcaacacaacagtggacatcatattgcaaaatgccaacacaatgaacctaaacaacagtgagacacatccttggcatttacatggacatgacttttgggtcatgggctatggtaatggcaagtttaaccaatctattgatccaaagaattacaactttgtgaacccaataatgaaaaacacaatcccagtccatccttatggatggaccgcattgcgatttcgggccgataatccaggagtttgggccttccattgccatattgagtcacatttcttcatgggaatgggagttgtatttgaagaaggaattgagaaagttggcaaattgcctacttctattatgggctgtggagaaagtaaaaggttccacaggccttaaattctataacattattgtccaaaacagattactttggtttaatattattttgattcttttgatagttgccaaaaatcaaaggccagtaaaaaatgtgttcctttttgttgtaaaacctctacactgtaaaaaaaaataaaaataaaattcactcttttgctgctactcatgtgtcataatattatatccttctttgtctcatcataatttagttttctagatttacaattctttctgtgagattccttcccttaaagagatttatttcaaaaaaaatagaaacagttcacatcataaaatataattttatattggtgaaataacttttagcagtaataagtaggcatattaacaaagagtgctaaaacttttacaatattacttcattgctattggtctaatgtcgtcggtatagccttttgggacatttacagaagaatgttgattacctctaaaaaatatatttaacgatatttaaactacgaaaaatggcctaaaatatcgttgaagtattagaaatggtacaaaattatcctctatccacctattggctccaaaataccattctcatccacctattgactccaaaatacccttgtcgtccacctttgagttcaaaatcaaccatttatttaatgatttaaatttaaactatttaaatataattttaatacacgacgctcaactatttgttataatttaacttattaatataatttattaaccaatctactacccacccattaataattaaaccacacccaataaataagtccgccccattactaatgcacaacatgaaacctaccaatgagtgtttctaaaaatttgaggtaaaagtatctttagaagtacattatcatacactatacaataaaattcgcgtcgagaaataataatcaagaacagaagattatatcaacaatcaattttactatttcaaatgcgagttttacaatctctatgattttcttaatttgacttttcaaatataaattcaagggctttaaagcttgtttttgaatctctgatgaacctgaacttgaactttatcttgatcttgacttttatttgaattcaagggcttcgagcttgttcctgaattcgatggtcttgatcttgtttgtctttgaacttgaatgcttaaacttgtagctttgtagag

SEQ ID NO: 215 - DNA, 3324 bp, Solanum lycopersicum
aaatcaaaaagttgtatttttggtccttgacaaatgacaaaagataattttcgaacgtattagcgaaaacattagacgccattaattctaaataaagataattgtatagaatagcaaattaatagcctaaaataaataaagtaattacgatttgatttaattgtactccatatcaaacgttagtcaaaatttgtcagtcgcctctctcccaaaaatctcgcttgtcacgctaccattctcgcttgccactctccctttgctcgcctctctcgctttatacacagaagtgtatgagttgtgcttctggtttgtataaagtaagagaaaattatatatacacatgcaataatatatatcttcgtgctatacacttaattatacaatttacaaacattttatatcaattcaattgtagacaaatgcaaattttatacaaaaattgcaccgaaaaaggctaacgaattatataattgtgaactatacaattgtaatgaaatacagttttcactcactttatacaacagaagtgtatatattgtgtttctgtttttgtataaagcgagagaaaaacatatatcttcttcctatacacttataattatgcaatatacatacattttacttcgattcaattgtatgcaaaacaaattttatacaaaaattgcagcaaaataggcagcgaattatataattatattgaaataggatagcgaattatacaattatagcgaaataggtcaacaaattatacaatttaaaccagaaaattatataattatatatgtatagcataattatacaaattttactttatcatataaatataaattttttaatttgctatatgtgaaaatttttgtaaatattactggtacaacaccgtataataactaatgcacactctttaattacgtatgtacttttctttcaaattcaaaattctattccaatagtacccttaccttatccataaaagccgctctcctctctccatttgctcacaacgcactcatattatttcctctgatacaaattgattccgaagcaaaaatgtcaaaagaagtgattgaagaaggacaagttcagcagcatggcaaagattatgtggatccaccacctgcaccgttgctcgattttgctgaactcaaactctggtctttctacagagctttaattgctgagtttattgctactctgcttttcctctacgtcactgtcgctacagttatcggacacaagaagttgaacggtgctgataaatgtgacggagttggtattctcggtatcgcttgggcttttggaggcatgatttttgtacttgtctactgcactgccggtatctctggtgagcacatacggatctagaattttactatttgaaattgaacttaaatgaaactaaactcttcgtgtgtgtgtgtgtgttgtaggtggacatattaacccagcagtgacatttgggttgtttttagcaaggaaagtttcattagtaagggctgtgggttatataattgcacaatgtttaggtgcaatttgtggagttggttttgtcaaggcattcatgacgcacccatacaacgcactaggtggtggtgctaattttgtgcaatctgggtacaataatggcactgctttgggtgctgaaattattggtacttttgtccttgtttacactgttttctctgctactgaccctaagagaagcgcccgcgattcccatatccctgtaagtacctctcactcataaaagttcaaattcccttgaatcagaattttttatatggcttggatgtttaaaggtgttggctccattaccaattgggtttgctgtattcatggttcatttggctacaattcctattactggaactggtatcaaccctgctaggagctttggagctgctgttattgctgataataaaaatgtctgggatgaccaggtaagtcatcgatgcccattttcaaactaagcgggtgaacaaacgactatttagcttaattctttggtatatatgtgcagtggatcttttgggttggaccatttgtgggagcattgttagcagcagcatatcaccaatacattttgagagctgcagctattaaggccttgggttctttccgcagcaacgccaccaattaaatcaataactaaagcattcaattgatctttttgtttatttatttaattcaatatgtgtttgaaagagaaatgtatgcaactctttcattatgttgtatgtaatgctagttttatcttagccttggatctgtgctgtatttatttgtatcatccttattagtattggtcatatttttcatttcaatcttccacttggattcctccctctctgtttttacattatcatattgtttgttcaaaatttacactcaatagttgttgtttacgttatgttaagacaaaggaacgtttgctaattttcaaaagattacaaaaataacactattctttccaatatcggcctttcttagttccttcattagaaaagttaactagtaagcaaaatctttgattgaataaggttggttccccaaattttgcaaggataaactcggataggataaggttgtgtgcacttagcccttttgggtcgggatcggattttattttacaagttaagaccaaaattattgttactttgggtcaatcatctcctaattgtaaaactactaatattttttgccattttgataaaaaaagacgtatcagtactttttgcctagtaccttaattcattccacaactaaacaagccattactttattaaattagttttaacgtctcattttattttgcttttaatcagtttggtgcttttattatgccaataatccacagagatgatgccacgtgtctccactaagagaggaagatgcttttctatgttttgggctttggtggttggtccctcatactgaagaaaggtctgaaaataattacagggctgagatgaaatgtgcctggcctattttgggctgttgaaaactagcaataggcctatttgtgaaaaacaaaacaaaaggtaaaaagtgaaaacaatttcattacattaggtaccaaaacaagaggagaaactgtaaagatgacttgatatggcaaaacgaaaggccactctggaatacacaagtcatgtgaggtgaggggtcatgagattgacaatgaaacaagaaaatcgaattttttatataactttacatgtatatttgatgtataactttaatattatcttctcataattcatataatgaatgactatttgtgggacgtagagtatgaaatagccagaggctagtacaattaattta

SEQ ID NO: 216 - DNA, 5720 bp, Solanum lycopersicum
gacatcaaggttatttttgtaatccacgtataagttatttctgatataaaaagaataatataatgttatgctacaaatattatgtcaatattgttattacaaaaccaccctaaaatggtaattaaagagaaacaactaaacaaatatcgagattggtcgcaatttcatgaatatattgtcactctcgtgacaccgaattcactcttaacaaaataatatggagttacgctattttaagcttagccctaatcgaagctattatatatattatttttcatccgttattggatatccgcattgtaacgtttgactaaaatcaagttgcaacaacgtagaggcatttttggggggcgaagacacttctaatagaaatttttatatatttcacgaaaagaaaatttgaagcatctgtttaaatacagaagaatctcaactatttcactacaaaactcggtataaaagcacttaaaaacttcaatcaaaaagatctcaaccaacactagccaataagaaagtgccaaatagtgcaaacccaataaaggatcacttccttattttagtatatagccaatctctaaacaccaaatggccttcacacaagggctactactacacacttttgggcatgccctattttatgctcacatcactatcccataaaccaaacaaactaatctcaaccattcatttcctttctacatggatggttagatatcatcccacatttcactcaattattggcccaaagtcacaccaacctttctcctaccccatcactattggcccaagttttatacttttgggccccacaaaagcccattaatttattatccaaaattatatatttgggctaccgacttctttttttttaaaaaaagtcctaattagccacttggcactttcaagaaccactcaaagccaaagaagaaacgtctagcaatgtacaagtgaaggccaaaaaaggagaaaaagaaaatcaagaaaaaaaaaaggtaaacaggaaaacaaactgtttcttgtgttcccatgtcaaaaagatagttttttttctttctatttttttttttttgggttggtgttttcttaaatatagtctatttgtggataagtagtcaaatgattagttttcttgatttcttatcttcaaagttttgatctttcagctttgtgattttttaagttgagttttgtgtatttgaaggtcaaaaggtgtgttctttattggattggtgggtggggaagttgtgttttgggggttcttggtgtgaactgaaaatgcagtcaatttagttgaatgaagtgaatttcaaataggatttgtttttgatgattttattgataaggggttggtgagttttagctgtaaattgatttttgatctctttccaggtatattttgcttttaattaactgtgtgtttgtaaatagatgtacatttatgtgaagggttgaacagtatgataaggaaaaaggttcaaagggaagggaattaacttgttgatctgatatgtaggttttgtgattcttgaataacagagctgaggtttgaaggcggattgtgtgaggactgaggagttttagtgaaatggggagtaattatcatttcaagaactttggtaatgagccaccaggtgagggtggaagtggtggtggcgggaagcagccggggaactttggattgccgcggcagccatctatctattcattgacgtttgatgagtttcttagctcaacaggagggagtggtaaggattttgggtcaatgaacatggatgagttgttaaagaacatatggaatgctgaggagaatcaaacaataggagggcctgggattaatgggcaagaggttggtgttccaggtggtcatttgcagaggcaaggctctttgactctacctaggacactgagtcataagactgttgatgaagtttggagggatatgtcaaaggagcatggtggtgggaaggatggaaatagtgttggagtgccaccaaatatacctcagactcagaggcaacagaatttaggggagataacacttgaggaattcctagttagagctggagttgtgagagaagatgcacagtttgctgcaaaatcgaataatgctggaggaatctttggtgatttgtcctatgctgggaataatacagggcttgcatttggatatcatcaagctaatagtaggaacacaggtttaatggctggtagtatccctaacaagaatggtgaaactgttattcagtctgctaatttgccactgaatgtgaatggggtcagatccacacaacaacagctaagaccacaacaactgcaacagaaccaacaatcacagccacagcagcaaccaattttcccaaagcagcctgctttgccctatggtgctcctatggctatcccaaatagtggtcagttgggcagtccgggaatgagggcagggatggttggtatccctgatccagcactcaactctaatttcattcaaggcgcttctctaatgggtggaggaatgaatatggtaggtttaggagccagtggggtcactgttgcaacagcatctccaggtgtttcatcatcagatggacttgggaagagcaatggagatacaccttctgtatctccagttccttatgtgtttaatggtggtttaagaggcaggaaatacagtactgtggagaaggtcgttgaaaggaggcagaggagaatgataaaaaatagagagtcagctgctagatcaagagctcgaaagcaggtaatagctcgaatcttacacataggctatgcctttcatgtctgcatgaattttgtattacatgtagcatcatcaatgcatgcatattacgaagaatgatggatcatgtatgaacaagtctaagtaataagctgggaatcatcgattgttatattctttcttagacgtagctgtgtgctctagttcactagttgaagagaaacgcagctacatctaagaatcaagaacttgtctgacctgtttctctaactacatgcaatatctttatgatttgtgaacttgatttactttccagaccgaaacataaatcatctgtcgattggtaaagagtcctcatgttaccaaaaaattcctgaaagaaatggcactagcttctcatcaaaggagtttatctcacatttttcagtctaaaattttccagtcaagtttaatgggaaaagtttgctgctgttttgggggcttcatatatgtctacttctggtagcaatactctcagtattatctgtcatacagccgagagacatgaacagccaatctggctcattggatgtcaaatgttaaaactaatttgcatttattccatcaaagttaatctctatacgactctccaaacctatcaaaaaaattagtaaaactctccagaaatccttagtgttaaataccatgccttcgcctctgattgttatactatatgtagcctagaccaaaaactagcccatcaaattcctttaatttcaaagtatgtgcatgtacttaacagtgcctcgttttaatatgttgttacactcttgtgttcaatgattatcatctttttaaatttctctaggcctatactatggagctagaagcagaagtcgcgaaactaaaagaagaaaacgatgaacttcaaaagaaacaggtgaccttttattcaatcacattgcatgttttgtctgtctcaatggttcatcactaactagattacactgcgtgcaggaagaaatgttagaaatgcagaagaatcaggtacataaagttctggttcctctttttccttcatgcttttatcttttctgcacaattttgcttccatatacattgttaaataattcagaaatgcactcattcatcgtggaacctgccttttatccttgtgtatgtataattggtaactatcttttagatcatccatccactcaccatgcctgctactttagccctatgggatcgaataaacacctctcagcatttttcctcgctgcctgaaaaacaaaatgccgttctttgctactgaaactactccctgaatcaaccatctcaagtcattgttttaaagtggctaagaaggcaccctttcttttagcacactaattcatccctataacctgcattttattctcactatgtacttcatctagtcaggccatccatgtcatacaagaataacagctcttttcggtttgatcctatccaatttttatccatagaagctcaaagctagtctaccttgctgatcgtgttgttttcttcttgaactaagctagcataggcatttttggatccaaaaacttatgtattgcatctttgtgacacaggttatagaaatgatgaaccttcaaaagggagctaaaaggcgatgcttaagacggacacaaactggtccatggtaaaaaagggtttcagaaattagtggtattagcccatatttacagacttatagtaggtgccctgtacagaaagggaatatgtattcactgtagatcagaagagaagagttgtctttttgctgtaggtttctcattgtgttaatttcttattccccttcgatggcatcatgcatagaatagagccagaatgtagaaatacctagttgacagcagatacacataaaaatacataaattaatggaggtacctcttgtgatgtgttctgtacaagtgatttggaatattgttttgacaagttcacttttaagttatgatgctcgaatcctccagaaatgaaaaaaaaaaacgaacgatgtatcttgaaagtaattatcgtaggagtctatatatttttaggaaaaagagttgaaacgattttcagtatgctgtctaaatgttttcccgaaagggtttaccacaaacaaaacttcaaaaatatcaccgtacttgcaaatgtgtaatttaacaccaattttcaccgtaagtgcgtaggttgaagatcactagtgatcttctaacaaaaggccatttcttcgatttttcaattaagacgagttttgacccgtcttctatattttcaattttccattataaaaaaaggttattggactgtatcctatgcaaatttgcatacacatcgaggaaaagcggctttgcttatcaacatcagaatacaatctcacttttacaaacttaaattaggtggtttcatgtgatcttgtgatatttagatacctcaatggatggtttttctttcaaccctttattcctcagaggctatcaacgtttcatgtgatctatagctaaaaggcttttcccatgcaaatgctgaagaaaaaccggtatttacacaacgcaataatataaaaagatgtcgaccaaacggtatacatactattgcactgtgcaaagcgccatgtggttgacatctttgacagaacgctctgtcaaagtagaggtggatctgaaaagacgctctatcaacagcttattttcggtctggagaacatctttaatgatgttacggactgaagattttagcaatacagtttcaaatacttctgtcagtcgacagaagcaggccatggccatataaacaatcagcaaattgccaaattgtctaaataattctgaagaaattttgggagtgtaaaaattagttaatttattgaatcatccttacaagcagcacaaggcatcaacaatcgaaagaaaaaggagaccgatgaattagtggctaccatcagcctcatcaatttgaaaagcaggcaacaaatagcatc

SEQ ID NO: 217 - DNA, 6302 bp, Solanum lycopersicum
cacaaagactttatgataatgctaaaattttgtactactaaattatctaaatttcgctattacattcattatttagtgatttttttttatctttatttatccccttgtcacctaagcttggataatttgtttgaacagtaagttcctatagtaaacaatttactttttctatgtatttgataattatcacatggatttggttaatactatttaatataatatttaatgcaactttttaaatacttttttttagtatactgatgataaaaagttatagaattaaaagatgtaattgaagctggataaaacctcacagaaatatggaggcatagtttggatttcatgataaattatgctttaaaggctataaaataaattagctaagttgaaatatcaataatttcaattgaacaatacaaccgtacatattttctcagttagaatatcatccttttctattccaggtatatcatatacttggtcatctatattattattttcattcgattttggaattcatattgaagcttagacaaaattcagatcgtgcttttaacatgatttaaatcatatttagggctcgaatctgagatttatgattaaggatgaaacactctcactaatacatcacaacctaacattaatgatatatgctttattcatagtcaattagataattatttgacctcgctgtaacgttaaaaaggttatgtaaatatttgaaaaataattttcaaatttaatataataatatctttcatttatcattcggctttaaaatactcttaacatcaatctattaactatgaaatacctctatttttttaccataaaaataaatttctcatttattacatatcacgatttataattaacctaaactaattagatttcaaccaaaccccaattcaggtaataaccttatatccgccatctacaaggctacaaaccccataaaattaaagaaaaaaattattattttagtatgttggttggataagtccccttcacaagagaaatggattggcttaatcagtcggtgattacgtgtaaattgtgctaatctccgttgcctaataacaatatttccattttcatactccacccgctgcaagcaccaaatcccattatattactactaaaaacgactgcatgtcttcttcttttttaaactcagcgattgccttctttttttgctctcatcactctttcttgcagttgtaggtatgatatgtcactttcttgctttgtttctcttgaggattaaccttttgttctttaatttattgctgttcttttaatccccaaatttggatatctttactagttgtgggactctgtttggttgttgagaaaagttttaactcttttatgaaaataataatgggaaattcaaagaaagttgctttcttttttctatttggtgatactggaaattgtatgggggtatatatggacatgggtttgggtttgaggagataaagtctcctttttgggatcttttttttttggttttacacaggtagattcgctgcaaaatcttcttgattcccttttgctttagatgttgcgcgtttgctttctttgaccagagtgtttattggaagcgacctataccgtagggagtaaggtttgagtagacttcacttgtgggattatactggcacgttgtagtttgatgacatgattcaacagtactatacctttctgtatgttaacaattttgtagacaacaaacttttttaccagaaactaatgcagaggtgacaagctcttcttgaaagagtaaagactttttttttatcttaacatgcttgtggaggatgcaaaataaattgtgctctcgatatcaataggagaggacagggtaatttgtgtttgctcatacactattgaagatagataacatactaagtatatccggttcatttctagtctactttgcagatttggatttctgggtaaaaggaattttatttattttgttggggttttgtaggataatcagaataaacaaatatgaggagtgctggaagaatgggaatccattatatgcagaaattgcacgcgtcaaatgttccaaaagaattggtggaaaaaggacagaatcgtgttatagaggcatctcttacacttattcgtgaaagagcaaaacttaaggtatgttattttgagttgggctcataatgagatgcttcatattagtatcacttagttctttccaattactacatttaactgattaatgaattaatatcgtgaatagaacctttgtgtaaaagctcttgaaccttttggtttatcttggtaatccttgatggtgtgggtgtgtgcataaattcagcactgctagttctcatgtatattagtttacctgtggcaatagtgtcaatgtcattttaaaaggaagttctatatgtgattggaattgataagcatgactaaacattttgtcagcaccagagatatttcaagaatttttgtattgtttcctcacagcatgatctgtgtccctgcactgtcacttaatctagtcacacaaatgaaatggacaagtggtagttgtatcctagtatgataatgggctatttcttcatgatggttaaggatagatggaacataggtttgtcaggggagaagggaaagaaagaagacaaccaactacttcggtattctcttacaagacattagctacctttaagggttgttgtttctcatttggattgacctactggtttgctgtagtgaatttttcctataagaccatttacacgtgaatgattgatttgtttcctgatcttttcaagttacttttatagggagagcttgttcgtgctcttggaggtgctgtagcctcaacgtctcttcttggagttcctctgggacataactcttcatttctccaggggccagcatttgctcctcctcgtatacgagaggctatgtggtgtggcagtacaaactctacaactgaggaaggtaagtaaagttatttatctgttgaaacaattattctttacattatttactttggacaagatgagtttcaaaacactaattttgttttagggatttatcaatcacaatcaaataatcagtaaatagtgggttaagctttatactcattctattcaatatttatctgttctggttatggaggaaacaaaacaatgcagttatttcttttgtgcaggaaaagaattagatgatccacgcatcttaactgatgttggtgatgtgcctgtgcaagagttacgagatgcaggtgtagatgatgataggttaatgagtatcataagcgaatctgtcaagctagttatggaagaggtaaagcataatttatgtaataacttctggggaagtatttgtctcctttctgcagggaaagcatactaatcataggccactggctacttcatccattaaattagaaaatttaccaaaatcatttttattataatgatatatcaaacttctagacccccatcctccccatccaaagccagtaaaaacagaaattttattgccgtgtcagagtccatactgacattttggcttttattgtatctcttcattatattgttcagagttaccagtgtaaagtaagcttgctcgccttcatccatatgtctattaaaagttagaaaggaaaaagtgaattgtcttcatgacctcatgtgttgttcaaaggagctcttttatccataatatgatttttgaagctggaaggacctgctcaagactgttaacagatgtatatatgtttaggcatcaaactattgtgccttctctaccctgctacagtaatcctgccaatttttctcatctcgtagtgaacaagagaaagatcttttgttgcatggaagatcttctgcccaactgttattcaatgaagaatcaatactcactgttattttatgacttccctttgcttctgaatcgaaatattttttacactatgatgactgaataaaatattattataactaggagctctactcaaagtattctcttcttagcaaggcctgtatgcttcagttctaacattttttgcttattttaattcccattttgactttttcagaatccattgcgccccttggtgttagggggtgatcactctatatcctatcctgttgtaagagctgtgtctgaaaagcttggagggcctattgatatccttcaccttgatgctcatcctgacatttatcatgcctttgaaggaaacaaatactcacatgcatcaagctttgcacggataatggagggtggttatgctcgacggcttttgcaagtaatatatgttctttctatagaccagctaagcatatataactttgtatgctatttcttggtttaatcaaatacaaaatatttaccagaacacttgatcttatatgtaggtgggaattagatcaattaataaagaaggtcgagaacaaggaaaaaggttcggtgtggagcaatatgaaatgcgaacattttcccaagaccgacaatttttggagaatctggtctgtatatctttaccttcgctttcctttaccttaccctcttgtattttctgtccaaatcatatacttgcaaatatgttcatcacttcaggaattctgaatatgatgagtctattccagatgcctaatactctcacatttctttctgtctcaatatatcctactataagctatgatccccttcaatttcattatatttgctgttacttaccaaatgtagcaactgctaatcttccattgtctatacgctggaattttgttatttatttgcttcattaataatctcaattgttcaactattattcttgtacattcagaaacttggcgaaggtgtgaagggcgtgtatatctcagtggatgttgactgtatggatccagcatttgctcctggagtatctcatatagaaccaggaggtctctctttccgcgatgttctaaacatactgcataaccttcaagctgatgttgttggtgctgatgtggttgagttcaacccgcagcgtgatactgttgatggcatgactgcaatggttgctgcgaagctggtaagagaacttactgccaagatatccaagtgacctgcagtaatttctaaaattatgaaggaagaattaccatgcatccaatagagaccactagatttgtactcatctttactggggaggtttaacagagaataagcaccaaaatgaagtgtttattcaccttattgtaactctaaaactaaaagctatatttgcagttcattatgaggaccctgtgattcttataatcttttaagtggtgcagattttgatgtgttctgttaacttgtgtagggatgttttgaatcttttatagtgttttcaaatagctgtagggaaaagtgtgtcagtgaattttaggcaaaagctagattatgattctactcttacactatatttaaatatattataaatatttaattaaatatttattcttttaaagtctgttaacctcctacatctattaagaaattatacattgatttaggaagtgatacattgaatcagttattaatttaattagcacgtaattaatatttatcaagaaattagatagaacaatcaatttataataaactggattctaaatatttttttgtcatattaatattgcttaatgaattagccacaataattttttaagttataatattttaaaagtcacatatcttacctcaatcttttaaccttctattatttgtggtgagaaagatcaaaagttgtttttttaatttaatgattttaatgatactggacaaagaattcaatgaatctataagtacaattatatatggagtactcattatatatgtgtcatgcttctcttttacttccacaaacaacatatttctcatttgcatctcaatttttagttattatgatattatatttttctttttatgctttagaataattattaatactattttgcatgaattttatatgggcaactttcacatatagtaaacataaaattcatatttgtatgcgataacaaattttgcacagttgcactccatagcaaacatataaatgtataattcgctatacatatacaattgaagcgaattatataaaacagagtgtataaaacgagaaagagagagagacttgggcagagaattgtataaaaacgaattatgtaattataaatgtatagaacgatcatatacaatttagtgtaaattaggtatataacattttttatagtaatattctcaagttaatagcactagagtttgaatttcattgtatgacatttaat

SEQ ID NO: 218 - DNA, 9849 bp, Solanum lycopersicum
actcgactagtgaattattgtagcttgcgcagaatgtccatatattccaagaatttagtcacttacactttgtttggattattgttacccattatttcataatgtattgtattgtattgtactgtattgtatggtagatacaatgttcgactagattatattgtttgttgctctttaatactattttaattgtttgatttgattgtattgtactgtattataatttataaatttacttaaatatccttaattattttaggattggagatttgactagatttaaataattaagataaaggataaaatattaatttaaaatattatgtaaaaatataattgaaaaaagaaattaagtaacaatgagaacacactaaatcggttgttccacaaaataggggtttccattgttacgaaacaataaaatttaagtacaatacattttaagtaacaatcaaaacaaacattataaatatagtaacaatataatataatacaatgaataacaatgatccaaacataatgttaaaaaagaaaaaaaagtcaagcagaaaggcgacttctttgtgatgcgtggctataattttttttggtttaccaactccgtagtaaaaagatttttcaacctccgttgctcttacatactttgtttagtaacatgtgaatatatattttaaaaggaaaagacaagcggtagaaaggaaaaattgactattttatccctaacaaaaaaaatcttaaattcaattaaaattgtgtcatactcaaaaaaaatgttataattataatttaaatttaatcaaaatttaacgtagactccgaacttgctaaacaaaaaaggtggggatgaatataaaaatgtgtggttattaaagagttaagtacaggtccccactaattaaaatactaaaaaataatggcctcacatgactactagtcatacttgtatgatataaactttccagaacctgccatttgttgagaaatgcaaaactcatttccaccttccaattaattacacgtggacgttcatgatcacaattttccctccatttgcaatgatgtcggttaatcatctctcacaatacatttctcttcaaataaatttccatttcataaacgaaacagaccatagagaacactcaaaaagctgaagtttctgttgctatatattgatatacataataacatatggtgtctgtatatccaacaccaccgggtcaagattttcactacatgggggatccgatgaaaacgggtcttatgggtttgcatccggtgcagtcgggtactagtatacatgggaatttgaatttggattcgaatacaggtttggtggtgtctgatgatcacagcaagaagacacggaagccttatacgattactaagtctagggagagttggactgagcaggagcatgacaagtttcttgaagctcttcaattgtgagtctctctctgtttttatattagctcaaggcacttgtttgtgttttgctgttttatgtatggtggatatcacttcttgttgttgaggaagttgaataggactagaataaaatggaagctttgtactttttaggttatgttatgaaatgggaaattgttaaaacattgtggagtaggtgaaggggaatatggagaggggagaaggatggacgcaggagctctgaattagggaacaaggatcaacttttaagttatagtatatctgcaaagttgccatgttggtgtaacagggtcaatgagggttcatatagccgaccccgatttgcctgggattgaggtgtagtagttgttatatctggtgcaaagtcgtcctggaggcactggttgtaacaaggctggttggcggcaaaaatctacctagctattgaaaaaaattagctagtcttaaccatacatggcaccatgttttgaccagctacaggggatcaaaaagtaggaaccaagaagcaaaactcattacctcattttttaaataaatctcactcgttgattgtcattgatggtacatacttattaaaatcaaagctacacatctgaggtatggagaaacattataggccgcatcataaatgcaaagtctagtcctggttgcgatgactttgagtaggctatcaaagctacttactagtaagaagaaaaacgaaatcagtctatatgggaaggtaacaatctcttggggcttggccaaagcttcaatagagggaaaagtgggagctgagaagaaaagttgcccatctaatgttgtcattgatgttatgcacttactataattaaaccttgataaatgtaaggagaagtctttcaagtgtttattctatcatagactatattcaactttgccactgtggtaagctatgtgccaacacttgtgacctctagctgacaagctaaaaagaaatcgaggctcggatagttctcgaggtttagctttaggataacggatagtatctattctggagtctcaatcaagagtcatggaaaaagcatatcctaaatttttgtgacttgttctttcaggttcgaccgtgattggaaaaagattgaagcatttgttgggtcgaagactgttatccaggtagtttgttagtcagatggttttcatttgttgacttatttgttcttttttcccgatctgaaagaatatctgatatctgatgtgttctgtagacaaaagaaataatgtttatcttagttatctagcgaaaatttgccttcagattgagagtgtatatttatcgtcagcgaaggtagattctagttgtgcaacatttgattttcttgaattgaccaactgtgttctattatgtagttgtgatctagggtggtttgtgcttctcctgttctccctttaccttcacaacgtgtatgaactgtaagcacaaagaaatgtgcgtgtaagaaacaacaaagactgtcaagaaaactagaaatggggtgggctctagactggaaggatggtaaagtgaatggtagtcaaagtgatataaaacaagtgaaagtaaaatctaggtatgaaaatgttgtgtagacagatacaacattttggtagtactttctcttggataccgaggggagccacctcttatctcttgttcaaaattagtcatggtgttccagaatgcgacttaagtatctctcacctggacgcagatattgtatcgtatttcctcatctcctacctctctgtttatctaccaaggtatgcaggatagaaagatttttgtgagaatacccaatgactttcttatatgtcaatgaagacttaaattcacccagaacgtatgtatgtgtatgtctatacatacatacaagcaattttcttacaactgttcgacaaaactgttctcaatcatgttatttcttcttccccatccgcatttgacaagataacttcttctttttttttccttctcaaaataactagaaaaaagggcttatcttttgtttatcttatgctgacccagtacaacttgcctagaaagtgtttgattatgaaacttgccattttctatgacttatcacacgtttacaagagcccttaatggtattaaaacatgtaactgatgaggagcaatacttcacataattttctgtcaaactatttaaatgctaaatgcattagtcttttagcccagggtgttcaagaattattttaggagaaacatctgttgtatgctggtgaagaactaatatcagctcaatgtctaggtcgtgtgccagttgcctggtcacagtttcactattatgttttatattttgatatgcgtcaatgtactaaagagcaagctatgcagatacgtagccatgcacagaaatactttctgaaggtccagaagagtggaactagtgaacatgtacctcccccacgcccaaagagaaaagcttctcatccttatccacaaaaagctcctaaaaagggtagggacaatgtcaatcatctatttgtttgttacaacagatcggactgaaactgattctaacttgtattgttgtatctgccttcaacagttatttcccaagtcggcagcatccaatttcaacctcctggtgccctgcctgtacccggatttggtatcgggcccgatcctttatcagtacctggaaatacaattaatttttctccctggacttacgacaatgtgcctgccattagcacgatacagacgagaaaaggtatgtgtctgatgatattaaggagatacatataagtgattcttagcgccttgctcaagaagaactacaagttgaattttgttgttctcagatgacgcacaattatccagtggaggagtcaagcaaaattgcagcagcagcagtaatgaaaacaaccctaggattaataagactaaagagagcaatgaccaaaatgagagccagaagcaaatgaaaggtgagtgtttttgttactcgggatgtgacccagtctaagctggtgaaatatttgtgacacttgcgctgcctgtgaaggcctcttagctgacttttgcccagcctaagctggtgaaatatttgtgacacttgcgctactgtgtaggcctataagctgactttctcgttttatcaatgtacttctttggttggatcctttcccgtcacccttttggtgcataaacaattagaacaaatttcatatatcaaaatataaatatgtacggaatgtgtattggcttgtaaagaaattgtgtgctagcgctcactaacatgatgtaaaatgctcagtagaactgtatgttatagcaaagcattctcttctgccccagttaggttttgtgactgatcttttcctactaacctaagtagtgtgtgacagttaggcctaaactgggtgttagtcgattggtaggtgcttgggatggattgtggaatgctcgtagaaatgtcaaattatttgtttttggagtttgatgttgtttcggtcgatatatagagcaatttactggtggaaaaagattatctgaccaactgaaccttatgggaaaattcccccgttatagaaatagaacagatttctatgctaagatgtttatttaagcagcctcaacttctttcactttttcatctccaatactgctcttcgaaggtggaagtaacactggctttccccctcaccttctcagttgtgtatatggatggctattcctagatgtaacaagaaatagtggcaacttttgtttgcctaatagtcgaatttaggcaaaggagttgttcatgggttaaaatcaggtacatgaaggaaacagagaagaaagtggaaagtactaggaaatctaatgggagccagggagatattcccggaagagaaggttgttaggacgagactgagaaaatgtattatcacatgacatttatacggcattgcacatgataactgtacattttgcagctgtgtatttacaaaattctgatagtagttaggtagcattaagtctgttggggtaaaagggaccaaattcatttgtcctatattgcatgtaagcagatggagaaaggctatatttggtttccttgtgctctttattttattctcatttagttccatctgttcatgtcatgctagaaggatgtgttgcagtaccaagtcagagatcactgttacttctttctttgcagttatttttatcttctcaaagctttattaattcaacatattgatttgttttcctttgctttgtaaattgcagttatgccagactttgctcaagtttacagcttcattggcagtgtctttgatccaagtacgagggaccacttacagagattaaaaaagatggaccccattgatatccagacggtatgttggattaaattagcagacgtatatgttgatgttagttccagtttgcaattcacgtgatgtatagttgtgaacaaagaaaggtgcagagacacttatgttgcatgttgtaactctgtacatgaagcatatatccttagcttggaattgaggcgtagttgtgtttgttgtatatgaggtgtaaatcttatactcgtctgatcctaactgagatgacctgaccttctttgactgccatgttgatagagaacttgaatggttaattttataggttaacattgaatagacagaaagaatttctctctctgcctctgcaaattgcagtaaagccttggttcctggagttttagattcttcagattggggggggatgttaactttgtcagacctcagatatccactactgcatgctgacatggaagtctatgaatggcttcatctcacttgactgaaagatactgttttgttggtttgcaggcactgatgttgatgaagaatctatccttcaatttatcgagtcctgaatttgaggatcatgtaagtcacaatctgtcaatttcatcatatcttaatcagtaaaggcttatgtgatgtgatctagttagaagtctcaaggtcttaatagagctggagaaattacacttggttcttttggagaaggattatgtttcttttttattgtggtttctgatatgcggagtcttatttttttgagtatcttcttgtacccgtgatgcaatagtttgtattgttaagaaaccaagtcgcgaaatttctttttttctggggaattctcatttgttgagttggacatgagctcaggttgtcttgggctttgaccacgtatagctcaggctacagtttctaagctttctgggatcatgagtctagatatgaacaggcgttctcaaattatagttgggagccgtctgcattctcaaattacaattgggagttacacttgtggctgattttgatctactatatataggcactaaataccttccctagatgcatctcttgttttcactcttcattcacctagccgcatgcatccctttggcggccccctctatagtcacatccaaggatcgtttgtttgcagtaatggattttgattatcacagcatccttgcaatctttgtccttttctatattttaccattgttctgtgtggtcaacggcgtcacaccactaagttatcttaacttagtttttgcttagtattttgtatttcttctgaaagtttatgggatactttgaagcgattttgagttttgaaaggactattgttgaacttttgttttaatctttttattctttttgtgagaagttgcatttctggatagctttttggcttgttaaccccatcttgggtaagattgcagaaatgtctgtttttaaaataagcttccggagaaaactcaaaccagatactttctaaaatcgagtgtgcctcgagaaacctctcacgaatacgagaagcttcacagaatagaaagaaaataaatcattcatagatgcaagcttttcctgttggcctaaggacttgcaagttttgatgtattgagatctaattttctgtacctacattagggtgttactttaatcaagtagagaaaataagatgtggtggtacataccaaattgacgaagtctttgtagaagcatgagatgaatggttacgcttagtgctgcagtatgttttttgaaattgctttcagaaattgtgattaagttatatttggtaaagttgtgtgaggcgagaagttgtactctacataaagaggccagccatcgccaagtggagaagatgagtcgtagatgtgtcgtttctcaagtcaatgaatcaagttaaaatttgacctggctggcagggatggttctatagtgtaaaaaagaaaaagatatgtgccttgagccccaaaaatttaaggggcctcatttttaatagtcataggttataagttattatttttaattaatagtcgtaggttataagttattatttttaattaatgttgaatactatttgtagaataagtgaacttttcatgaataatgaagaaaatattagaagaaatttgacatatttggtgtacaatatctcatgaaaaaaaatttaaaatatgaataattgtatcatcaattgaaaactagaagaaattaatcacatcaactttaaggctcatttgattttagctttaggccactaaaatacttaagccgcttctgctggctggggcgcagcttccgcccagtgtatatgcgttcttattttccgtcttctttctggaaagtaagtagacagcaacaaatggatgtcgagatagataaaataataaatgaattatgatctggagtaaggtccctgtggattttttacctcctatatccattggggtcttcactgtcactaggataaatgttgcgtagtatgaaacctaaatgaattggtcagtaatccattgtttatcactcttatcttattgatcttattcgttatcccatgcttggttcagaggaggatgctttcatcatatggcctgggtgctgaaaaagataaaatggaccttcctataaaatctgatttcagaggtaacgccatccgagctatctaaaggaggctggaggaaggttcagatgattcatgctcattgcatatgattggtggagacaattgtacgaagagaatggtgtaatgtaaagatgttttgcttgtgcatctagtgtgttcatatgcttcaaacaagcatgttgccatctccatcctgtatatatctcgttgggggaacaatgcgggagtatgctttaagaggttgtatcttgtatgtacttgtggagagtagatatgtaggcttgatcagctgtattatagattatgtagtgcttgtgttgtatgttgtagagggctgtgcccctcattggttctgtcctaagaaacgcccaatgaatcagacactttgtagcagtagtgtgtttgacatgtggagaagaaacgaaaatgacctcttgtgttttgatgtaaatggatcaatgacataatagtattggtggagaggaatcaaaaagtgttacaataaagaggtgtatatcaactgaactattacgatttgttccccattgattcataattatcctcctaataggccattcaaagcacaaatgactgagaaactttatctttcacttctaaaaatatgaatcaatggggaacaaatcaaacaatagaggaaaagaaaatcaaaaaacttcagcaccaattcaagcaagtcaatcatagaagtagtatgaaggttaaagaattcactaatgtacctaaaattgttgatgaagtaagtatattcagttcaagattaaacctgcgtaaagtaatctcacttctttgaacttgaagctatcccatctattctgtcaacaactttcttcttcatctctttcatcgtgcgatctaactcatcaagttcatccatacccatatcatcaagtggcacctccagtcccaaggtcacataatcttccactgcctcttcatcaaccggaacaacttcaccgatctccggagcagatgtggcagcaatgtagcgattcaccacggtgtcaacagagggatgaccgaatgcaaagatattgccggccaaagaaaacgtgatcacagccgcttcagcgtcgcatcttttgaccaactccttggttttcttaaacagaccttgtctacgttttgtgaaagtggtatgccttttagccttatcctcaattttcttgatttcaacttttgtacgtaccatggttggcagaaattaacctgcaagggtttaaatctagggttttaacttcttttacacgtaaaaagaagaagaaagccgtagcattcactagaaaattaaaccctagatcttctgaaccaattttgtgaagtgaattaagaattcatacagagaaatcatagacagaaactaaactactacttcaaatattgatacgaatgattagtatagaaacgtgatgattccattgaagttgataacaagttagtacaattcaatggat

SEQ ID NO: 219 - DNA, 3537 bp, Solanum lycopersicum
aacctatgttgatcaataaattcaccattcaaacaatagaactatgagttcaaattatatatatatatatatatatatatatatatatatatatatatatatatatatattacatctttttattgtgaagaaccaatttaatttttaaaaactcactagaagaaacaaaaaaaaaaagaaaaaaaaagagaggtctctattagccagaaaataaattttattttcttggtggaaatatatcttcacatattaacaaatcttttattatatttgtgattttcatcttaaaaaatatctacacatttgtttgacttcttccaaatgtgtgtaattgtaactatcttaaacttttaactagattagatcaaacttgttagcaaagaaaattaaagaaatataaattatccatacataaattttataattaaataataaaatttatcattaattctatttagtgacaaattgactatatattattaaaaaaaaattagatactagttatttagcaatgaagtttatagttaattttgttaaactctgtatttatcaaacacgtaacatagtccttagtttatgatcattgtgtccgagctagatttcgaacattttaactaatttcacatgatatttatcagaatgtcacctcttattgtaacaggtaattttgccaacgtgaacatggtcctttcatattataatttttacgatcatagaatttgaaccatatttcaaacatttcaatcaacttccatcagtaataaatatcagataattctatccaccggaatttgcgaaaatggttcattctaaaagaaacaatctcagccaagagatatatgacagccacatgtcaaaacaaaggcctcactctttcactactaaaaaatcacataaaggaaatccaaatccaaaatacattatccaataagcttctgcttaggtgtacattttttgatcctcaaaatccatttattttcatataaaaaccttcatttccaagctatttaatatatagttcatttcttcatattgcaaaaaaaataaaaaaatggctacttctgcaattcaacattctgcatttgctggccaaacagcacttaagtcacaaaatgaatttattaggaaaattggtagctttgaaggtggacgtgtcaccatgcgacgtactgtcaaaagtgcaccacaaagcatatggtaatttttttaatttatcatttactatattttcaatcatattattgttaatttttaatgaattattcattgttcatttagtcatattattatttccatatttttaaataaaaatggaaaaacaatgcaaaaccttgaaataatcatgtcaactactattttgtgacatagaaatataatgtctttagtgttgattataggcataataaatacgtgtatcctttaatttggtctcatttcatgtttatgtcctttaactttgggtctgcagtaatagtagatacttaaacttgtataaacttgaacaagtagatacatgagtcctacgcgttggacaaaaaatgccatgcagcacatgtgtgtctatttgttcaagtttatacaagtttaagtatctactattgctcacgcaaagttaaacgacataaatgtgatttgaagtcaagttaaagacagtctggtgcactaaattgtcagtactatagtaataaagggttagacgaccatattaagtctattagtgcacaactactattcttgacctcctgctcacatgacgatcgaataggtatggagaagataggccaaagtacttgggaccattttctgagcaaacaccatcatacttgactggtgagtttccaggtgactatggatgggacactgctggactctcagctgaccctgagacatttgcaaggaaccgtgagcttgaggtgatacattgtcgttgggctatgcttggtgctttggggtgtgttttccctgaaatattgtctaagaatggtgttacatttggtgaagctgtttggttcaaggctggatctcaaattttctccgaaggcggtcttgactaccttggtaacccaaaccttatccatgctcagagcatacttgccatttgggcatcacaagttgtgttaatgggctttgttgaaggatatagagttggtggaggtccattaggtgaaggcctcgacaagatctacccggggggtgctttcgacccactgggccttgctgatgatccggaggcatttgctgagttgaaggtcaaggaaatcaagaatggacgattagctatgttctcgatgtttggtttctttgttcaagctattgttactggaaaaggtccaattgagaacctttccgaccacattgctgatccagttgccaacaatgcttgggcttacgccacaaactttgtacccggaaaatgaacttagtacactcttttatctgtaaaaattgtgaagctactgcatgtcttttatgtaatcatatatatgcaaaagccaagactacataatcttcaaatttaatcactctgctcatttcaattcgtttgttttacttaaacttttctttttagttcgtttccaaaagaatttacataatcgtgtcacttataaggtaactatatacgtaaataagcattacttgggaacctggaagaaatggtaacgaatttgctgtaacaggttaactacactgatatgatcgtgtataaaaaagtatcgcgtgtgtactatagatggagagaagtatcaatatcagaattttcatatttacatttagctgtcaacgcacgccacaaaggttgagtctttctgacttggtagcttctgtgtttgttattcaaactgagttcaagaaagaacttatcttgatcagaatcgatcatttctgatcgaagaatcagttcgtgtgtgaattctggcttgacagatgcatgattcttgatttgtgtcatcagttgaggctgtgagaacaatttacttgttctgttttttctctgcttttttgctttttccaattgtctgaatctttgttgcagcagaacaattgaaggacctgaaatagtaggatcgttgttcggccttcccatgaaggagtaggagctagttttaggggcggaattgaaccaagcaaattagttcatgccacgacgaagaaaggaggactttttttctctcttgttatgactttatgaggggttgaaatgtgtagatataggaagaaaatggctagtatttgacattttgtttattgaattttcacacatgatgtagaaagggagccgaacgggcgactaaggaacaaagtccaaagaagaaaatgttagaatttatatggtgacttttttttttgcagaggaaaatggtaaagggaagtgtccaaatggtggagtgtagcatttggaaggttgtgtttgtatgaatcaagggtttggtatgttatgtcggccaatcatgttcgttggtttttcttatactgacgatgtaaataattcagtcttaaataagttgcagtcagctatatgaaatcttcactagtcgt

SEQ ID NO: 220 - DNA, 6577 bp, Solanum lycopersicum
aaacagcttctcgaggggcaaatcgatcttgcaacatttgtgcagaagtacaagaagctacgacagagttatcacaaacgcgcacttacacaccttgctgcaaagacatctataactggctgaatgttttgcttaatagaatatgatgtgtgtgaatattatatagctgagtcttcctttgcttcgaaaccggcgtgtatcataatattgcttcagatgtaattttgtgacaaatttatgccaagtctggcctccactgggtatagcctgcttgatataagaggactagttaagtaaccattttataagacaatcagttatatttactgtggtgtagatctcagaaaatggcctgctttgccttttctgatgacaggtatttggatcaacttgcgtgtgtacctttaatttgttggattggcttattaagaaatcaatttaatgttatgcacgtgtcatgttcttacatttttttaaaaatttattcttttaggttttaggttttttatctagcgttcgatagccgactattttgtatgcgtgttgtgttgtatagggtttcattcaaaaggaaatattttttatagtaagaattttctcacatttaaggcttaacccagccgcccttaaagaattagttcttgctagacatagacatgacttttaaagacaaaaaaatttactcatttaaagagcaaattatgtcgttaaataaaaatatttgtacaaatcgaatgtaaagttaaacaagtatttttgtgactgtttatgtggctattcacatcttagtgtttatgtaagttcaaaattgatctatgtgacaattcacgtcttaatattctatgaactaaatataaagttaaaaggatatcaacaaataaagctaaattaaagagcatatatttgcttgtacggctagctgataatgtggataatatttctaccatatatctaacatatgaatgtctgaaaatccactttacatatttgcttctccttcaccatcaccatgccagtttcggtcaccatttcttccttctctcttctcactgacactcaccaccggaccaccgtgatccgcccaaaaaacccacttcaaaatcgttcacaactcaccattaaatcctccattgacaacaagaaaccaccttcaactaagcctacttcatgggtcagtccagattggcttactaaacttaccaggtcacttactttaggccaaaatgatgattctaacatacccattgcgagtgctgagcttgatgatgtttcggaacttctgggtggtgctctttttcttccattgtatagatggatgaatttgtatggacctatttatcgtcttgctgctgggccgaggaattttgtcattgttagtgatcctgctattgctaagcatgttttgaagaattatgggaagtatgggaaagggcttgttgctgaagtttctgagtttttgtttggttctggttttgctattgctgaaggtcctctttggacggtaaattatcctgctttttttttgttttgtgtatcacttcatggttattcgtttactttttaaaattaattgtggaactttgatttactccctccgttctaatttatgtgataacgtcttacttggcacagagttttgattaaaaaataaggcttttgaaatttgtggtctaaaacggactgaattgagaaagggggaaagtatttccttatgaaataggcccaaatatagcagaagggatgtagatgattcatgtagccaacttcaattagtttgtgttaacggataatgcagtgttaaatggatttgtatcggaatgaaatgagtccaacaagagcgaaacagatgcataggcttcatatagctgacctccaattagtttggatattgaggggttggtgttgttgaactattacaacatttttattggtattgcaatgaaatgagtccacatagaatggaagtgatatagaagacagacctaacaagttgcaagtctaaactggcacatagcagttgatgtcgttggattttgcagcatgaaaccttgtggttttaatagagagtttgaaagttccattttagttgatgcctcacaaatgagagccctttagtagattatcaaaataaaaggataacttttatggagctttaatttggaaattagggtcaatacttctgtatcttctatttatgtggaatttggatttaatctggtgaatgctaatatgaaatctagatgtccccaagattctcatttttcctgtttactttgaatttttataatttgtaaatttagtgtgtgggggaaaaacattgtcgattctagtctagcgaaaactaatgtaatgtcaaggtgacctcttgttctgataatgtatccaatgatttatttgttagcagtttatagttataattgatggaaagtacagtaccctagtataacattattatggtcaccaatgtgttgttttgagcttaaaagcctaatttgatataggcaaggcgaagggctgtggttccatctcttcacaagaagtacttgtcagtaatagttgatcgggtcttttgcagatgtgctgagagaatggtggagaaacttttacctgatgcaatttctggctctgcagtgaatatggaggcaaagttttctcaactaacacttgatgttattggccttgcactcttcaattacaattttgattcccttactactgacagtccagttattgatgcagtttacactgcactaaaagaagcagaactccgttcaactgatttgttgccatattggcaggcaggtccttccagtacttgaatggtttttgctgagcttaatctgtctgataatttgactgaaatcatcgatgttttttgtagatcaaagctttatgtaagttcatcccacgacaaataaaggctgagaatgcagtgtcattaatcagacaaacagttgaagaacttattgcgaagtgcagagagattgtagaaactgagggtgagaggattaatgaagatgagtacgtgaatgatagagatccaagcatccttcgatttttgcttgctagccgtgaggaggttggccaagattttaactcatttgatacttaactgatagattacaaaacttcttcgaaattgaacctcttttaggtaaatagcatcatctatggtatgttaatgtgaatcacagttagtaccactgttttaagttctcatgcaatcaaagtcatagtcatagctcccgagggtgtggcctagtagtcaataaagtgggtgaaaaaagaaaatcataggagatcagggttcaaatctcaaacgagaccaaaaacgctcggtgatttcttcttcaagacaaaatactgcatatttagctttatatgcagtctcagtacatgttaactttctgaatttcaggtttcaagtttacaacttcgagatgatcttctgtcaatgctagttgctgggcatgaaaccacaggttcagttttgacttggacggcatacctgctgagtaaggtaccttggattgaccttcatcttgaatccttagttccctcttaagttatcattctatatttttccaacttgaatgacaaccaataattgtacaaagaagtgcaaagttgctttttattcttagtacttggtgcatattttagttgtattttccatcttaaattaagcctttagaaccttttacatttaaaatattgcactgacttttttggaggtaaacactcactcccacaagtacactgagaaataaccctactcttctgtgtgtttatgtcaaagtcatggttttagcatttgattttaaaatgttgtttttcaatgggtgagaaattattcatgcaagacaatcctttagcttggttttcaaccatatctttggacattggtgttcattcatgtaagttgaaaaagatttcttttaatttttcctttttttggcttgtcagaggaacaactatttgaagtcaacttaattgttgtggcctgtgggttctgtctcttatctctatgatatttacgctgacttaaattcctccccatccacaagaaagtacattatggctcaaagagaagatgacttagcctgtgacatgtgttgacttatctaaaaagagataaaaaaaaagaacttgtaaaatatggtactcggcaactaaaagaaatgccagttaaagagctttttcttaccctaggacaataccggttggacgtcttactaagaattgttctatccgtatgtttctgcatgatgtcacttatggtaacacatattaatcatgtttcatctctttcaaccattattcttctgtttaggaattcttgacaggtttcattttcctttgacaaatgcagttgcttcattctagttttcctcttggaaatctttcggtctttctttagaagaaatggcgatcccgtgagcatatgtttttctgatataattcataatcttgtattcaataaaaacacggtgcatgacggaaactatgcagactgtagaaaacctgttcttccatcatattttatgttcttaatgcaggacccttcctctttggaaaaagcacatgaggaagtagacagagttttgggaggacgctctccgacttatgaagatatgaagaatctcaagttcttaacacggtgcataactgagtcactcagactctatccacatccacctgtaagttagtcaacttttggatgactttatagtgatgcattatcttccgataacctaattttttagagaactggttttattaggtcctgataagacgagctcaagtagctgatgtcctccccgggaattacaaagtcaatgttggtcaggatataatgatttcggtatataacattcatcattcttcagaggtaaaatctaagggtttttttctgatctttcacactttttcttgttactgttgagattgtcggaaattgttctatttaacttttgcatccacctctcaatgttaactcttgctcagtaaggtctatgtcaccagtacagaaaataacttgtccttgctgtctttttttccaggtatgggatagagctgaagaatttgatcctgaaagattcgacttggaaggtcccgtcccaaatgaaacaaatactgactttaggtactcatttcaaccattagtttttctctgttcatagacagcttttttgagtagaatattatcattcatatgtttactcgttgcagattcatcccgtttagtggagggccacgaaaatgcgttggtgatcaatttgccttgttggaagctacaattgctctcgcaatatttgtacagaacttctcattcgagttgattccagatcaaactattagcatgactactggagcaaccattcatacgacaaacgtaagattctcacctcgagagctagctattttcttgttctaacatgagtaacaagttatccccatataaaccgtttacatcattttcgattgcagggtttatacatgaaagtgaagcaaagggaaaaagtatctgttttggctgctgcaccgtaaatttagtcacaggagaaagaaatcttgattctttgaacattatatacatctttggtagactatgagaatcatcattattgcattatgttctattttttctctggcattattgccttcttttctttctttctatatattagaacatattgcgcatctttcaaaaataacctctctatatctacgaggtatagggggtagagtgtagcgtacacatcaaactctctgcgcccaagatcctaccttgaaaatatactgtatgtattgttgtatatcagaatatgcctttaaagttgttggagatgcatcgattgttttcggttgaagtttgaactctaagaaaatattcgtttgctagtgtataaaaataatgttcaatagagtgtattagtgatgtttgtattagttatgcatagattattcttatgcattgtttgatttggtgtattaaaataatatgcattgtataaaaatatttgtttactaaaatattctttacagttatggtgaaaaagatgtaaaagtgcttttgaaggtaatctttaatcatgctaatgtatatattaattccctttgcattacgaataccaataaaacccatgatattagaaacacacttcttgatgcacaatagagtacataacataaagaagtgtaacaaacaagttactaccaatgcgcagtactgtgtattgaatatttttgctaatatattttacgaaaagacgctaagtttatttaaaatgaaaaattaacttttttaattgatataaattttttttataagcgatataatttatgaaatttctgattaaagatgaaattaagactagtttgacatgattatatcaattataatttagaagaacttttgaccaaatttactaatggttattaaatgagtcatcgatctttcatcgaaaagaggattacgcaatcaaattaatgctacaacaagttttaattaatctatactgcttttgccacctaaaagtagcattaataatatttttcagataaaaaaaatatg

SEQ ID NO: 221 - DNA, 11441 bp, Solanum lycopersicum
atacagttttatgtttgctatggagcgcaattatgcaaagtttgctataacatacaaatatgaattttttgttttctatatgtgaaagttaccctatattaatttgatgtttttcccaataaaataagcgaggttaaaaatccaaaatcaagtcacacaacaacaaaatgggcttgatgagctatcatgagcccaaatagtattaatttcacattgggctgagaaagcccaaggatcaatgagaatgggaggaggatctctttgaggcctatcaaagaacacacatccaaaattttaattacaataaacgtaatatcgtaaattacaaaactatagatataatattgtgaatatcagagacgttattgtaacgagataaaatctaaaaggaggtccctaaaatttgttctctcttttatgctttaagtaaatgtaagatctacttatactctatcatttttcgactctgtttttgcaactacattgaatttgttattttttttttctataatcataaatatctttcgcaaaaataaaatcataaaagaaaatttttactttaataaaataaataagatttggagaaaagcgctaaaagttaaaattgtgctatttcatagtaggttgtcggaatttgcttcttagtgctaagtggtaagagaatttctctattcagccttcgactttaattacatactttatttgcatatgatattcttacaaacacgaatcatcgtaaggaaagagcacggaggctatcacgttactgattccactctgtcatatgaatatgatctctgagcgcttacaaattgaatagaaaaaatatgatattttcaaatctccgtatttataagaaaataaaaatatcgttacacgaaaaacgaaagaacaaatttataaaaggtttaaggaaaccattcatatccctaataatttttgtagttccaacattaccctcaattacaaaagccctacactacacaaatcttggttttttcttctttcttctccggcgtctcttcacttctctctgcgtaatttttctgcgtttcttctctgcgattctcggtaagtttttctctctctacattttttgctatgcgacttttaagcttctctgcgtttttcctctgttttttgtacttgattttgtttctgctataaatctcccaaaaaacgagtgtatttcaatgttagtgatgattgaatcgttcagtatgttgttgttattgagtgaaatgttaaggtgaagagaaaaaacgagtaaaactataaagagaaagtgttacttcatgcaacaaattaggagtcgtttagtagctggtttggagatgagttatgcaagcatttaatcctgcttaagtagtactaccactttttgtagctggtaatatattcaggtataaaattagtaggatgttcggtgtgcaattttaaaaacttgcatgattaatacatgtataagttatgagtgaatctatgtattattttgtgcatgtatgatggaataactaaatcctgcaaaattgatagtatataaattcccggcataattctaaccagctaccaaatgatatccaaggatatagggatcactatgcacacatacaactcaatagggtaatgctaagcatcccaaaggtgaaaagtgaaaataaaatatcaatggaaaactttcgccacttgccttacaaagcacatgcgacgatatatttggtacaatgagatataagaagctttaaagaacctttgactttgggagtatggagtttttctttgtgtaaattaggaattaaaagtcattagttcaataaacataatttcctttcgtaacaatttatatgttgttgatagtaacttataattattttgtgtttgaataaatttaggcttaaaatttttgtagtactcatttcttttatagtgctaacaactttcttttagtttctatctgaatttgtgattgcttatttataaaatcagctccaacacttgaaatgtgattttcagcaattgatgcttaaatgttacttaaaatacagataattcaaaccggttaattgttgcttgttgatttgaagttactgtcataatagaaccctctgtggagaagtcttggatctgcggctaaatggatgaatccaaagaagaaacgaagtctttcaaagaattaggagtttgtgatcaattgattgaggcttgtgataatttgggttggaaaaacccttctaagatacaagctgaagctatgcctcatgcctttgaaggtttttcagtattcccttctttatgttcattcatcttttcgttgccgcatgttgcagtggatttggctttctgctagtaattaaaataggtttttatttctaagctgattatcccagtgggttctatgtctgattttgggttgtgaggttgcaaaacttccactgttctatttagttttgcccttggttgcaaaattaatcaagactagtgttatgaataatagagaagcaacatttcattgtcgaacaaatttgtggagagaggtaattaagtgctgggtttagtggtgaatttttcagtcttccaggggtttagggtgttctgatttaatttactatgtctaggggaaaataattagttactggatataatggtggtgtaggtagggtgaacttaaatccatataaaagaagctttatgtaattgcataaagaggtggtgtttgaagtgattcaatttaagggaattgaagattttggaacgatatattattttacgaagataaattggaatagcaacgggaaggatcaggtggattttcctgtaaaatacttttatgaatgctagcctttcagaaaccatgtctttaaaatgcaaatttacaactaagttatggaatataatgttgcatttttgaggaaaatttaatggaccgtgcaaaactccgtcaatcaagtgatgtgggttgttgtaataactagcaataggagagtgattgagctgtgattccatgtagcctgagcccttttgtggggtgggtgggtgggtggggatccttttgctgtgtagagtacattattcatagagatcctttaattaaccttttgtatatcaacctctatttggtgaaatctattttttgttataaacaatttgattggtttttgttccaggcaaagacctaattggtctggcacaaacgggttctggaaagacgggagcttttgcaattcctatactgcaatccttattagattctccgcatgccttttttgcctgtgttctctctccaacaaggtctcttattcttctgattacttgttttattttgtagaagctctttaatgattcaaatctcatcttttttgtttgcatattccagagagctcgccattcaaattgctgaacagtttgaagctttaggatccggtattggagtaaaatgtgcagtggtgagcttcactaagtcatatgaacatacatgaacaattcatttccccttcaaatgtaatcataggctgataaacactttctagccaatggaatttgtagtggcatgtctgtaggaaaggataaagtgtgtcacgattgaacagtctggtatatgatggttgacattggcattcagctagacatatttttgattaaatgatcgctggtaattgttttgcagctggttggagggatagatcaagtacaacagagcattgccctcgggaaacgacctcacattgttgtaagtactgatatatctattaccacatttttatgtctcttgttaaggtgacacaagtagtaatggagttacagatagtaaaatctccttgccaaaatataaactaaaaggaaaatacaatatgaggcagagttggtggtgtaatatctatttgtttaagggacaagcaccacctgctttattttacctctgatgctgttttttgagtatctctttctcagccttgactaagtgtatcaggtcattgtagcctcatgctattgtttggagcatgcagttagcttcgtaagtttctgatgtcttctttcaacagattagggggtcgtgtggatttccctagatacatttaaaaaatcctggctgtaaatagctatttagttacatgttaccttaccccactttgtttgaaaatgctttctcagttttttgttaaatttgttgccagtatcttgtgagaagagctcctagtccagctatcagggtctttactgtatgttagtgaccttttcttcttagatcatctgataagaaatgtgcttatgttttaacttttgcaaaatgctttggcttataaataagtcctttatgaattataagtagccatctcctatgtcagaggtacctgatggttataaaaggtagatgatatatccttttagcaatctaatgaaataaagttggtatactattggtctgccttgaaacatgaaaaatcttagttcctggtatgccgttttcattcagcactatgcaccatcctaggtttgtaagatcagtaacctttatttccttatgagaggctgcaaaagaaatatgcaaaagatcatgttatagaagtctggagtggaaataatatgatatcaagctgtcgactatttgttttttattaggtaaggtaagtaggatatcaactattaagtgagtggaagtaatacaaaaatcagctattaagtgtgctgagacgggcaaccacccaagaagattttcttccccactttgcctatgaggtctatcaggcatggatgtggtgataaatcccgacatctttttttagaatcggatgtccagctgtgtaggaagagtccaccttccaagggcgatgttgggtgtagtatagtactccacaggaaaccgcttagaccaagacgtcaactattatccatctagggcagcaatccttccctaaatttgtgatttttttaatttgactactcctaaaagcaaatcactcaatttggactagatacaactccggacccactggtaggcattccaacagtttctcctattgcctatgagaagacttttggtgtagactcaaccttttcttttcaatcatggaggtggttttgtcttagcctctctaacttctgccttgtttgcaagtaggatagtttctctgatggactatttggaggtaaagaaatcagaaatgtttttaaacagtaaagagaatattaacaagttgaagtacaaaacccttctttattagctctttgattcaagttaaatgatgtagatggtattgatagtgtactagatttcctcaatcggcccacatgtttgtgcagccggaggctgtgtttttgtaaggttcctgatgtatcgttctgcatcatcttgatgcaatttaccaatacaattcttacttgcctatcaaagataactattaagtgtactcagtcaattcagttgctggcctaacttcaaatattcagacatatgtaatgttccctggtcagcaaaactagtttagaatgcctcgcagatgattttttacaccaattttgctaaacctattgtaggtcgttacagatgttatcttaagccataagctcaatctttgatattcttaaatttgagtgctcatttgcgttgatgtatgatgtaggttgcaacacctggtcgcctcttggatcatctttccaataccaaagggttttctctccgtacgataaagtacttggtaagttcgtccatagagtcttatgctcacaaatgctccagagatgtcctcttttatctgtttatgcatttctttttctttcagatgaaaatccaagagtgcagatgttgttttatttatttgtttgaaggatatgttattatatcactactgcacattaaaaagtgatgtttgctgtttttcacagtgtatatacagtatatctcttgtcagaggcaaagttacttgtcattttttcctgcctccattggctcttgagttggtctttactttctaactaaccaacattttgagctgcagaaagccttaggcgaccttagaaagatatgttcatttgaatcttgctcgtctttgtgttagttgctagttaaatgccttcccctcaatacagcactgaatcattgatgtgatatgtccaaagaagcacaatggcttcatcgccttaggtggctacaattggaccgagcaagacattgattaattgaagcaatatgtatctaaaagtaaaaatgcatttcgttatatgctattcaaatgataagcaagaatgggttgatttaggatgacatggattcttaacaaatctgatgttccttctatgtatcctggtttatatacttcttttaacatcgcaaattctatttgtaaccaaatataggtttttgaaattgtaaatagtgtttcacaacagattattttagttagttaagagcatgcatgcacagtctgtgtcatgaatttgaacacagctacatgcaacaggtattagatgaggcggacaggttgctaaatgaggattttgagaaggccctcgatcagattttgaatgctattccccatgaacgaaggacttatctcttttctgctacaatgaccaaaaaggtcagtttttcaagtgtttataggaaaccattgttaattataaatgttctattctctgcttgtgggtaatttctctttctagattctctttaaggaaaatcccctctctatggttgggtagatagcttttcctcagtatttgcggagaaaaagtgctttcatgaagttttggctttcattaatttttaaatatcttgctcatttgatatttatttatgagaatataccagaaaacagaggagctttatacttgtatttcagcttttttcttgtactggcgtgcattgatcagttatcattattatggaagtatatgcacttatactttatagcgtagaaccaaaactattattacatgaaattgttcgagtctttgagaggagaaggtggggatgttatgaatggcacgttaatttgcttctgttctgcttggctctttaaggaatcaaatttcacgcttaaactttccatggactgacctttttgcttgggaaatctgattctaaatagatatgtacttgaaatacaggtgcggaaacttcagagggcttgtttgagaaatcctgttaaggtacaacaatgtcaattgtcaccagaggattttaggtgctcaagagtattttccataactttgtttataatttctttcagattgaagctgcatctaaatattccaccgttgatacactgaagcagcagtatcgttttcttcctgctaaatataaggttaatttttcagtgacgagattctattttagttttgttggaaaaaagcaacacaagtggcaattggcttaataatgatgttccatgcatgtttcattttgtttgattataatcgatgagttcaatattttctgcttaagcagcaaaattgtccagacatttagtgtatttttacaacagatcattatatgtggtgctgtgttctccaataatgatcattatatcgctgaagaatgtacattggcattttgacaccactaaaataagaaacaattacgtggataaaagaggggagacgtgatcataatgattgtgttgtttagtgttacaaagtaataactaacatgaagagtgcaacatcttcttgatgcatcttcagtgaaccttctttactagataaaaaaactaagtagcacagcgaatcactctttacaaggttcatatttttagctttcccagaagtattaatcatgaaagcattttaagtagttgcaactcttgattattgaagtgaacataatcccactgacttagaggtcaggccacatatagggcttgccgcagttaaggcatatgcagttaaacatctgtttaggcagatggatctctttatatgttcctaatcaagcaagttactagatttgtagtcacagctatgagctttcttatacttctatccttaataattttttttttgcattattagtagaactattgtagtctcagctatgggctttcttacacttctagccctaatcaattttttgcattattagtagaactattactccaggaacttagcagtatactagtgcctccattaccttttcccacgaacaagagggtagagcagatataacaaagaaaatgtatatccccctgtcctcggactgtcccctcaaatatgccatctttggttggcctctccctctttccctggtgagcagaccttcttttgagatcttatgtacgggttgctccccagcaagatgtataacagtattttgtagatccataataggaaatccttttgtttaggcattgaaaattatcagaaggataatatatctaatgcctggtaatcgtgtgggactgtatgctagagaccatatagaaggaataaacttaaaagaccctctacctgatgggctaaagatgtaattgctttggtctactgaattatgatttatggtcctatttcaattatgaaataatgacttctggtctgactttattatttgtccatggttcacaggactgctatcttatctatattctgactgagatgtctggcagtacatctatggttttcactcgcacatgtgatgcaactcgtcttctggctttgatgcttcgcaacctaggcttgagagccataccaattagtggtcagatgactcaggtatactctcatacttaaaacatattttaacaggttcacaatttcctctttgctggttctatttcatccccacccgcacacccaaaaaaataataatcatattttacttggtcaggataaaaggcttggagctctaaacaaatttaaggccggagagtgcaatatccttatatgcactgatgtggccagtcgaggacttgatataccgtctgttgatatggttatcaactatgatattccaacaaactcaaaggtggatcttgctattcttcctgcttgtaaagttatgctgttttcattggggtggtcctggatttatctatacttgagttgatactcatcaattcaatctgaatatcttaattttgttttctggtgcgatttaagcttatcactatatgcattgcttgcaggattatatacatagagtgggaagaactgcacgagcaggacgttccggggttgccatatcattagtaaatcagtatgagttggagtggtatatacagatagaaaagcttattggtatgaaatacagaaatatttccgagactctagtaccctcccccccccctcctccttgtgttccttctagtctacccgctgctatgtattgttttccaaactaaaatttgataatctccagggaagaaactacccgagtatcccgcagaggaagaggaggttttgctactcttggagcgtgtcacagaagccaaaaggatctcattgatggtatttctctcttcggtgttttacttttctaggggatgggggcaggagggggttacttaagttgccacctaggtggttaacttgtggatgcatgggttaaagctcttacttcagccaattaaataaagtgcaacgaaccctattactattattcatttcccttttataacaagacagtttggattggcttattttaggtgttttaaagctaaaatagcttttaagcattgttttcgtgtttgaatataataaagaagtgcttttaagccaaaaatcaaaagttagaaatcctaacttatggtttttgacttgtatataaggcataagctataagccaatccaaacaggctcataaaatactagttgaattctccttgttcacctttttcattaggctcgcgtgttaatgtcacaaggtagagctagtagtgcgaaacatattttgctttgaggtgtgtattggagttaggtctggccatcattcacaacatgcgtctcttatgtgcttttctcagtcagagaatgttgttcgaggtgacatacatgtaaacgactttctccacgagtatcttatagttgctcatattcatgatgcttgcatgctgatacactatattgctcgactccaaaaatattgccacacttgagtcagatcctcaaaaaatgcactactttttgtgttattagattctaattaaaacatatgcgacgggtgttgatgcagaaaatcaaagaaactggtgggaaaaggaaacacagaggtggtggagatgatggtgacgatcaagaggttcataaatacttgggagttaataagaagggaaaacaatcaaagaagccaaagagaaaatgagggaattaatgtgtaaactaatttagcaattgtttagtccaattttgacttggttatttattttattattgtttactcatttaggggactaaatttgacatttcatgaatttgtgtttttgttgtcaatgataatattttcttatatatacgtataaaaaagtaattgatacgccaaaagtattattatcccattaaaaaatttaaagggatttatccattacccacttgtcatcataataagaaattccataattagttaaataacactagttaaaatttcacaaattcaaattcaaattcctcaaaacccataaacgaaataagttacaatatggtggtgtatactatgataagcatcgttctcctttgtgcattcatcatcttagttattttcgttacgttttgtcaaaacaacgataaaaataatagcgcgcctacagacattgaggcgcgtacaaaagttagaggatcgacccgtgagacatatgatgcaacaaccgatggagataatggtggagagaccatgcatgggaacaatgacaatggtggttctaccgttgtggctagtgtcatcgccacaacggcactaaacaccatagctattgatgccggaggagggagttatcaaggtcatggaggtggtcaaaacgcgaattgatagattgtggtggagatggtgacggagggtggatggttgaaaaaatagtaatttcactatatattttttttaaaggaaaatgtttagtttcatgtggctagtagtttttgccacttgttcaactcatatttatgtgaaattaaaatatattgtggtggagatttcaaagtatcgtaaataagtaatttcaaaatttataattttacctatgttacaatatttttgtgactatataaaaatgtgtgttctagctattttttgggctctataattgaaaaaaaaaaatactcatggtgaaggtaatgacgtgtgtgtgatggtggttgaataaattaaattattgtaatttgaaaaaatatatatttttttaaaagtaaaatgtatagctttcacgtgattagtttttttttgtttactagtagtttatgtgatctaagtaaataattttttattttaaatatgttataacatttttgtaactatatagatt

SEQ ID NO: 222 - DNA, 3238 bp, Solanum lycopersicum
aattacaaattttaaaaacgaagtcttttttttcaataaaaagttttacattgttttataaatttttttaacatagttttatatttagttagatttcaatacagatacgatggtaattatcgaataaactatgtaaggaaatggacaaggatccatgaatggagatcggagccccacatgaaattgaaaacatcaacttaattttgggatctcgaagtttacttggcccctataattgtgccacgtgtcatgttcattgtaccctactaataccgacacacaaagttatccaaccaaggccgacaccatctggtcccacaaggacgacctcacacgttgtcatcctacgtgtgtgaacttcattggctatctgtcaccgtcaaaagtacagcgtgtctgtctctacattattctaattacttctttttaatgtacacatcctttttcatcacgtctgtcgtgtaatagagtaagcaaacgagaaaatattgttaagagtgttatatttgaattcgggctctacatgattaagattaatcaaagacaatgtagacttgctcatcaaatggaaatattgcgatactcattcaaagattgtgtaaaagaaaaagtaaaatcaatgttcacctacaaattatattagtataagagaaattcgtaatcgttatttttaaaatataaatgagataaaaattcattcatgtagaataatttacaaattacacaacggtcatagtaaattgtattaaacatgtctaatatgacgagctcgactgaaaaataatgatgaatttttgtaataaaatatcataaattacactaattcagtcgtataagtaaaaattatttgtccacttgtcgtgctacatgacgagtatttaaagttgatatacagtggaaagtgtgaagaacaaaaaaagccacgtagacgtcggtttaacttggtgtacttaattactcttcattattagtattattattatgagacgtttgaactcctttttttttattactatatcgaaaataaaaaaatcttaatcagcgtaacgtccgtgtttgtaattgctataaaaagcgcaccaagtctcatatatttcaatcacatccaattcaatattcaaactttcacttgttgataatatctttttgattgaaaaaaagaagaagaagtatggctgatcaatacgaacagaacaaggcatccgttgaagagactgttggtaccaacgtggaagctactgatcgtggtttgtttgatttcattggaaaaaaagaagaggaaaaaccaagtcatgctcatgaagaagaggcaatttcatctgagttgtctgaaaaagttaacgtaagtgaagaagtggaacccaaggaggaggaaaagaaacttcatcgatcaaatagcagctctagtagctccgtaagtctctctttcgttcatcattaatatttacgtcaaatcaataaatataacatacgccttttatgatgatacatatattatacttttacactatttgttttctcaacaaagagtcgagtaaatttaccgtttactttttctagcgggtatgaataaattataggtgatcattgatatgttgtacgtagattatatatgttgattgatttgcagagtgatgaggaggaagaaattggagaggatggacagaagatcaagaagaagaaaaagaagggattgaaggataagattaaggaaaaaatatctggtgatcacaaggaagaatcgaaagcagaggatacctcagttccagttgagaaatacgaggaaacagaggagaaaaaaggatttctagacaaaattaaggagaaattgccaggtggcgggcataagaagacggaggaagtggcggcgccaccaccaccaccaccggctgcggtggagcatgaggcggaggggaaggagaagaagggatttttggacaaaattaaggagaaattaccaggataccactcaaaggctgaagaggaaaaggagaaggaaaaagactaaatgaaatgaaatgtttttttaattttacttttgggatgttatgattgtgtttctgtgttgttttggtttttaagtgtttttcatttccttcacttttgttttttttggattctgaaggataattgttagtactgtatttgatatttctgtatgtaagtgcatatgtatgtgccttatgtgtatgaagtttgataatatggatttgtaaaatgcagttgattttatccttattgacttctttgttttatggtttagttgtttcatttccaactctgttatatgaagacgtattgttcaaaacatatcgagttattatatataaatgcaaatcttagagatattaatatgataaaagatgataaaaattctagaatttctatttaaatttctatcgattcatctccttataagaaagtaccaaatctattgatcattcaactactccgatataagaattagtcaatcaaatattaatagataataaatggaatggtataataactatcatcatactatagtcaaagcatctttaaattgcaatattgatataaaagatatttatataaccaaaacaatcattaaaatgcaaatatgcaatcttgaatagtgacattaggtatttgtatgtatagccaaagcatctttaaaatacaaatatgcgatcttaataataacataagttacttgctataaattaaatactacctaacaatataaaaattacactcacttcaactttaccaaagaagttctcacagaagcaatttttttagcatgcctttatggattagacaagattgcaattcaagcaataagcttttgaagaaacatggaacattagccatgaggcatgagctgtaagagtaaagttgaggttcattaagtgtgtgctttacaaagtgtaaagtgcatattctatgaaatggggtaacataatggtggggaactggaaaaataatgagcatagattgatttatgcatcttaatctaaaaagcctgcaaagaacacactctgagatgtaacgataggacgattcagtatctggaacagttagtattcaaaatatttcgcgttagccttagaaaggatgttgggaaataagaagagctcagagtcacatatactaaaattcataaaatacaagttttggatttgtgatatatgcatacttgataccaaatgaaactgaaaacaaatagctaaaattcaagccgaaaaaaacttacaat

SEQ ID NO: 223 - DNA, 3763 bp, Solanum lycopersicum
cttcaatttaaggttgatttttaatcgatatttttcaaaaaattaaccttttggatttagtttttgacattcttttagcgtcatttgatagaatatattggaaaatctaacacttatattagtcctggtattacttaaatcttttatttagcagggtgtataaataaatgcataacaaaccatgatattatccaatatccatatatgggctattaatacatgggataactacccttaatataccaaaccaaacggaggataagaaataattcctcgtttcttttgacatgttatttatttttaaaatatttttagttattacttttgacatattaataaaaaataattatttttttttatgttttatctttaacgttaaatacttattctccaaatcattttccaaaccctaatactccctctaaacaactataacaatatttatccactttatgaaatcaatagataattttacacttactacttaattttacccttatcatttactattttagtcattttcccattatatcaacacaaagtatttattatattcaagaggtgatataagaaaattacattttttaatatagtttctaaagaaatatacaaaggtcaatagcggatgagtattaaacataatttttttctcaataggcatgtcaaatgaaaccataacgagtgaaatgaataaagaaaatagctaaccttactaataaatcgtattcttatacactctactcactaaaagcaaacctagaactccatagttaatcaatcataataacttgtctctttatttgtgtgtgtgttgtctgttgaactacagtctgtagattgtccttccttcctcggccttgacaagaaaacactgaaatgatacatgtatccatcactccaccaaccaaaaaatatatgaagaaacaaatgctgccaaaattcctatataaactcctaaaacaaaccaagaatccaaaagacaaacagagaagccaaaaaagagactttcccttctagttttctgccaaacattcatatctctttcctcattagtgaaaaactccacctccttaactcacatgtccactgaatttgagaaacataaaagagtaaaaataaccttaactttcctttttacaactctcctagcttcaaactcaaaatcccttttagtattatctccaattatactctaaaaatggaagcttttcatcatccccctattagctttcactttccctatgcttttcctatcccaacaccaacaaccaattttcttggaactccaaattcatcatcagttaatggaatgatcatcaacacttggatggatagtagaatttggagtagacttccacataggcttattgatagaatcattgcttttctaccaccacctgctttctttagagctagagttgtgtgtaagagattctatggacttatttactctacacattttcttgaattgtacttgcaagtttcacctaagaggaactggttcattttctttaaacaaaaagtaccaagaaacaacatttacaagaacgtgatgaatagtagtaactcaggagtttgttctgttgaaggttacttgtttgatcctgataatctttgttggtataggctttcttttgctttaatcccacaagggttttctcctgtttcatcttctggtggattaatttgctttgtttctgatgaatctggatcaaaaaacattcttttatgtaatccacttgtaggatccataattcccctgcctccaactttaaggcctaggctttttccttctattggtttaactataaccaacacatctattgatatagctgtagctggagatgacttgatatcaccttatgctgttaaaaacttaactacagagtcatttcatattgatggtaatggattttactcaatatggggtacaacttctacacttccaagattatgcagttttgaatcaggcaaaatggtgcatgtacaggggagattttattgcatgaattttagtccttttagtgtgctttcttatgatatagggactaataactggtgcaagattcaagccccgatgcgacgattcctacgttcaccgagccttgttgaagggaatggtaaggttgttttagttgcagcagttgaaaagagtaaactgaatgtgccaagaagtttgaggctttgggcattgcaagattgtggtacaatgtggttggaaatagaaagaatgccacaacaattgtatgtgcagtttgctgaagtggagaatggacaagggtttagttgtgttggacatggtgaatatgtggtgataatgattaagaataattcagataaggcattgttgtttgatttctgtaagaagagatggatttggatacctccttgtccatttttgggaaataatttagactatggtggtgttggtagtagtaataattattgtggagaatttggagttggagggggagagttgcatggatttggttatgaccctagacttgctgcacctattggtgcacttcttgatcagttgacattgccctttcagtcattcaactgatagttaaactgtttacaagtggggtatcagtagtactagtactatgaatagtgtttcatttggaccttaattaattgtatttttagtgtttaattatctagtgtttttatattaccaagtctttagtaagaagaaagtttgtactctactattgttggttgacttattaatatgagttttacattgatttgtgcttatatatagtttagttaggtatctttttttacttccttttgaaaataccaaagtagaaaaccctaatcattaaaacaacaagaatatcgttatgttgtcaattttaccgatgattttattagcatatcatagagtattcgacatatttacagtacacaaccatcttacaaatctaattttctaacttttttttgtaaattttaaccaaagtttacgatggataatcgatatataattagtttattatacaagctaaaattgttaggatccctcgttttgatttgattctaagtcatttttttgccacgtggaatataataacctcatttgctataagaaagttaatttcaaagttataaatgaaaattagcttctggttgattagttggtttttctcttgaaataagtgaaaagtatgaaaaaagaaaaagtaaaacttgttcatctcataatttttaagagtgagaacaaaatcaactacatgcaattattggatgttaatgttaaattctacataatttctaccattctaaaacccttcttataaacttccactaggtatagtattgttatatatgtattgaaaaaaaaaactttattaattacttttgcatttcacaaaaacaaatgaatttgtgaacaaaacaagtttttcgaaggtttcttattctgaaatttaaaattttctgttgataaatggtaacttgtaacgtaactcaagttgtaagctaaacaaaaggcattatacataaacagacactcaaactaaatctcgtgtagcaagtacacactccaacattgagagtgaacataactcgagttgtgatcaaaggggtacatcaaaagaacgacctctataagtgccaaaaagaaatagatcgatcaatgaattacatctccattcccaactagttgcgattagttatgtatgaattgttatacgtagtctgccctacatggcacgaaaatttttttaggataaaggaaaacaaaattgatagc

SEQ ID NO: 224 - DNA, 2979 bp, Solanum lycopersicum
ttcaaacatttgttgatttgttattatatacctaaaacaaaatttttattaattaagtaggtgatttaactggattttattttatttttatatttggatcacatatatacttgagactatttccccttttttcttcaccaataattttgaaaaataattaaaatctttttcagggaaaaataactaaataaaaataagtgaagtcaataaaacgtccaggttgctgacgtcattaaatccgccgccttgattgatttgcccacgtgcgctattggcccattgttacaatttgccattaaaataattaacaaaaaattaaaatattctcaaaacatcctcgttggtcactcttctttttttcatttccccattttacccttcctttctcttgcactacctattttacccctagtcccctattattattttttttaaaaaataaaaattcccgtccgatatccaatgcccactctagagaccaaccaattaccagtaagtctcattctagaaagcaaaacacaactttatcaaaggcaattctatatcatgtgctcgaactagacaaggctgatgaataaagaaatatttgtcacttaatctaacttagatagttactccctcagtctcaattcatgtgacatattttaatttttgaaattcaaatacatttatcacgatcgtaaatttttcatacatcttttaaatgtgatttataataatttttttacataatcagcaacatataagttttatctctaaaaaattaaaaattctatagtcgaattttttattaaacttaaattgttcgatttgtaaaaaaacgatattgggacataaaaagtattttattttttttcatatttggctccacctacaaataatttaataaaatttttatgtccatttagattttccttgtgggacccaattcaatttttagatatatatatataaacaaggccaaccaagcccaaagtgttaattctcctagtattggactataacttgaaaaagaaaaaaaaacagagcatcccccaaaaaaaaaacaaacagagcattcattttttttttccaaaaaaataaatggattcttcttcttcttcatctcaattcttctactcaatgaattctgatttaaattcatcagattcttcatacgaatggtccaatttcaacacacaatcttatctccctttcaacgtgaacgactccgaagagatgcttctcttcggagttcttaacgctgctcatgaagaaacaacatccgaaacagtcacatcgcatcgcgttaaagaagaagaagttacctcagaatccgaggttattgaagcaataccggcgaaggagaagtcgtaccgaggtgttaggaggcgtccatggggtaaattcgcagcggagataagagattctacgagaaatggggttcgagtatggttagggacatttgatagcgcggaagatgctgctttagcttatgatcaagctgcgttttcaatgaggggtaattctgccattttgaattttccagtggagaccgttagggattcgctacgtgacatgaaatgtcacgtagacgatgattgctcccctgtagtggcgcttaaaaagcgccactccatgaggaaaaggagcacgaattccaaaaaagttaatagtattagtaaagtagtgagggaagttaaaatggaaaatgtaaataatgtagttgtgtttgaagatttgggtgctgattatttagaacaacttttaagtagtagttcaagtgatcaaagtagttgtgatgcaacttattttagtccatggtaaaatcaaagattagtccatgggtttttttttattaattattttatttttgttacttttttggggtgggggtggtggggggagggttacatctctttgttctttacttgaaggtcactatattgtaaaaattttggtgatggatgtatttaaatttctaagcgaatgattttgctagataactagttagtctcattcttctattttcgtgtttaatttaacgttcgaaaaacaggttcacaatataatttttgtatccaaaaaatgtaatactattgatgatgagaaaggaatctgacacattttaaaatagacagatttgacctgtattacagtcttaaaaaggagttatttaacacgtatgtgtataaggtttttcctatcacgagccactcaagtagattgatttaaaaaagaacgtgtatatggacaaatgtattattagactcaaataaaacgtgtcatatttcgaagtgtgaaaataaattgagctttttatatattacatttttcaacatcgacgatcttcttaacacatgttaatccaaataaacaaacctaaattgaatgcgacactttttaactattcccattgaaagaacttgacttttatttatacataggttgacaaataaaaatttgcaagttggtatgaatttaacaaagaaaatactatatgctaattttgtagagcctttcttggaaactctcaatagatctttttcacataaaatggttactattttggtccattttcaaacacaaaataaaaaataaaaaaaggaaacaaagaagattcttttggtcttagatgttaggtagagctaaaagctatcatatcctataattatatttttcttaatattataggtgatccaagtgcatcgtacacaatttacttgggatcttttatgaaataatttattttttaaagttatctagaagtcaaaatcccactttggtagaaaagtgtataatccaatctaagcacatagatcataattttattgcttatctcatatattattaatgaataaaataattaactagagaacaaattaattttttatttggagcaatgaggtcctcattcatgaatttagctcttttgagctctactctttaagtttgctcattggttaaaacctacttttaaatttggtaggtcaatgggtt

SEQ ID NO: 225 - DNA, 2994 bp, Solanum lycopersicum
  modified_base (2655)..(2994): a, c, t, g, unknown or other
ttcatattttacgcttagatgatatatatcctaataactccgcgtctcattttatatgtcacttttttatattttaaaagtcaaataaatttatctttaattatagatattttaaacattttgaattatcaattattgtgactcatagtactttttacagagtttataaatatataaatttcattcaaaaaaaattgaagatctcatatgcaatttccaaccaaacttaaatggttataaattgaacgatacattcaaataagtactaacgattataacaacacttcttttttaaaaaaaaaataaaaaaataaatttgtggtaggagatagagaaacgaataaaaataaaatttgtggtaggagattgagaatgaggttgtatcataaatatctttttttcttaaactttatacatgcacgactataggttatattagaataataaaccattaactagcaaggtgttatcgtcctagaattcatattttcgtgtttgtctctattttctatataaaaaaaaagagattagaaattagtgatcacaaacaaaatattacactaaaattgattattactcttatttagcgatgaataaatgataaatgatcgtacacattatattttactacgagctatttacagacgtgttaacaatgagatttgaaccttggtacaacaacactaaaagagtcttaagtacccacccaagagtcattgtaccaactaaatcatctattcattgggtgctctatgttaattttatataaatacctatcaatttctacatagatacatacagattccgtaacgaagttaatgggtgcacgagcacccgacaaacaccatgtggatccgcccccggctatttagtgataaattaacgagataattatatatattttgtgtgtgtgtgtgaaaggaggggcaccactatttctctttcctcatccaatagtgggggtctatatataaataacctaagcaactcaacagcttttgagactctcttgacaacccaaaaacaaaaatcaaaagatgtcaagcccactagagatagatacttcattttcacattccaatttgttgtttttggaagatgaatcatcatggagtaatactcatgatccatttgttgatattgatgaatatctaccaataattataccatgtaatgatgaagaaatagtagtagaatcctcaaacactagtactacaacaacaacaacaacaacatcaaaagtagcaagtatccaaaatattcatcatgatcaagaagaggtaacatccatagagaaaaaacatgaagatgatcaagaaaaacattatattggagttagaaagaggccatggggtaaatatgcatcagaaattagggattcaacgcgtaatggaattagggtttggttaggaacatttgatactgctgaagaagctgctttagcttatgatcaagccgcattatcaatgaggggtccttggtctctactcaattttccaatggaacatgttaaaaaatctcttgaaaatattgagtattcttgtaaagatggattatctccagctgctgttttaaaagctactcataaaactagaagagtcaagcacaagagaagtagtagaaagaagaagaatgagaatttggaaaatgtttttgtttttcaagacttgggagttgaattattagaagagcttttaatgacttcatcataggaatgtttattatattcttcgtgtcgaaaatactaagttcagttttcgtgggagataataatcaagatcgcaatgtacgagtctctttttttcttttttttatttgttctggatttcttgaagaatttagagtttagtttcaagaagagcttttgatgagttgaaataatgtttcagacttgttttggtacatatagatttgttctttttttttaaaatttttattcactttctttgctattttgttataaataaataaataaatacaaatgctcaccatgagattcctctcttcttcttttggaatttcaatagtatttttaattaaaaaaactaccccatatcatttttcagttttcgtcaacattctcttatttaggtgtaggggccatttttccgtttgtttgggtgtagggagtggggtgggggttaatgctttaaaaataataatatattttcaataagtggttgagtgtgagattttaattttatggattttttatgaagtaaaaaaattatattcaatagatatatcattcaaatacaagataagttattcgagagtctgaaacttaaaggatacaaaatattaacaaaaatttcaaaacgatatataaaattttaataaaatcaaaatggtaaaatcgctgcagatacaacgacttatctcacctgaaaaagcaaaatcgctgcagatacaacgattttgcaaaagttatttttttaaataaaaaaatgaaatcgctgcttagacagcgatttcataattttgtttcttagaaatcgctgccttgacagcgatttcatttttttttaaataaggtatatcgctgccagggcagcgatttataatttttttaataaaacgctgcccaggcagcgactttatgaaatatatattttttttatataaaataaatcgctgccaaggcaacaatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 226 - DNA, 3136 bp, Solanum lycopersicum
attgttatatactaatactttatttgtatcggaactaatttcccttaccaaattttatatgtggatatttatacgtagattattcttgtcaattttgtttagctttatcctttggatatctatgttagcccaacttgttcaccaagtaaattcaaatcaacagtaatgcagtacagtagatattttctctaggaaaaaggtcaaaaatgtcatatgttaaaggaataaaaatatttttaatttatagttcaatttaaaaatatttttattatcaatattttaatttacaaatattcttatcgtcaatacttatttccgtacttcattttttttttccgcacagttcattttttatagcgacaatattatttaaaaattttatgatcatacactcatgcattttcttcttaaattttttacgatgaatgtaattttaatacaataaaataaatagttcataaaaaatattgcttcctctattcctaaatattctaattttagaatgaatttggagttaattatttttgtccctttttagttattgtcttgtattaaaatttagtttatttttaaatgtttgcacatctataattgatatacttttaagtttatatttttcattttactcttgattaatattaaaaaaattatttaagagattcattattattatttttttaaaattgtaaatataattttgattatgtttctaatcattgatataatcgaatagaaaaacccaaatcaaaaagaaaaaaatcaaatttattcttattcaaatcgattacacttcttgaaaatcaaaactaaaaaaattctcaccgaccatcttaaaaaaaaatcaaacgcatatcattaatataatagtaaacaactattatttaacgatagaaaaagtaggctactagtagtagtgtatagatgtgagagagaattcaaagaacccaaagtaaaaggtacccgacaagaaatttcacaacttgggagttatcacttatcaccaacccccctccctccaccactacaaatacctccccatttctccccacaccaaaaccaaaactgaaactaaaacaaaacttttctatacatttttcatttctgtatcaatcaatattctttgtttctgctgttttgagtaaatcacactaagatgtgtggtggtgcaattcttgctgatatcattcctcctcgtgaccgccgtttgtcatccaccgacctatggccgactgatttctggccaatttccacccaaaatgttcctctcaaccccaaacgagctcgaccctctacaggtactagttaatcatatataaagcttaatttgttgattttgtttttatgctcatttaggcatttcaacaaacaggtggtgagcagatgaagaagaggcaaaggaagaatctttacagagggataagacaacgtccatggggtaaatgggctgctgaaattcgtgacccgagaaaaggggttagggtttggttaggtactttcaacactgctgaagaagctgcaagagcttatgatagagaagctcgtaaaatcaggggtaagaaagctaaagttaatttccccaatgaagatgacgaccattactgctacagtcatccagagccccctcccttgaacattgcttgtgatactactgttacttacaatcaagaatcaaataactgttaccccttttactcaatcgagaacgttgaacctgttatggaatttgcaagttataatggaattgaagatggaggagaggagatggtgaaaaatttgaataacagggttgtagaggaagaggagaaaacagaggatgaagtgcagatactttctgatgagctgatggcttatgagtcattgatgaagttctatgaaataccgtatgttgacgggcaatcagtggcggcgacggtgaatccagcggcggagaccgccgtgggcggtggctcgatggagctttggagttttgatgatgttagtcgtctacaaccaagttataatgtagtttaattattgttttgtttaaacttttcataattttattttatcgaattaggaagaattgagtttttataatttaatcaattgtgtaaaactatgtttctaattcattaatattatattggatatgttgttattaaaaaatatttttttttaattattttgttagaactatattttattacataagattcaaatttgagagcccttattaataaaataaagttttagtttaattttgggaagaaatactgatttttaaaatagttaatagtgttaaattagtttttagatctaattcacaattaaaagtcaaaggctagatgtaaaaaaaatacttttcaaagcctcataaagagtttatccaggacttttattggtaacttttacgagaaaaaatgactttcaaaagagaattaaaattattttattttattagtaagaaatactactaattgttgatttatttccatgttatataatttttttttaataattattactttgtgtccgtcaaaaaggtgaatgaagaacaggcaacgcggagttgcaaaaatttattctactcattgaaattatcaaaaaaattaaaattctagaactttgattctcgaaatttcagttgaatcatcgtgcattatggtagtaagctaatcaatcgatttttaatcatttgttgatatttccactagtaatttggtaacagatagatggaccagttaacagtagtaaattattataattaattattgagtactaaattagactcaaaataataatatttttgaaaagagaaaaaaacaataaacaagttagatgatgcaaaattgaaattgtcgtcattccttagcaaagtgtgaaaacttacggcgctgctggttttgttgtataaaacgaatggcgcacctcgcaatagaacagtaattgcaagttgcaacctgttgtgcggttcggattccctgtctacaacctaactaattaagtacgtaatttattcctaatgatataatttttaattataaatataatgattatgtttgataagatatttttagataaatttagatagagtaattattttaaaaaaatattaatgtgtgttttgaggaaaaacaaattatgatctagaaattca

SEQ ID NO: 227 - DNA, 3457 bp, Solanum lycopersicum
taccagttatctgccacctgtccattatctctcaagctttctagtatcttctccgacaaacatacgtgaaatatacctctaaattctcgatcaactttagcattatcttcaatgttaaaaaaaccataaaatatatgttcttcactttaattcttatccgttgattcaatatttaataaatgtcgaatctgttatgttgtggagcctgattaatatttgatgtactgtcaaattttaggctgtactgttcattctcaatttattctttgtaactgttcatactccgaattattaatatataccccaccgccgtgaaagtttacccacggagtgttaccacgaactattggtttctctctttagatctctctcgaaagttcttgtgttcttcattctcaagtgtgtgtgaatgaattcgatcctaacaaaatccataaataaaattatgacatatgtatatcattagtacaaaggatacacacacgatgacaaaaatataacgaagaatatctcatatttttcttttttccccccttttatttgtttggtcaacttaaaaaatgaagtataccatatgaagtaaataaacactaataaatatagtaattgattgtaataaattacttacccttaagattatgcgttattgataattttcttaaattaaaactctggactctggagtatagcaatgtatatatattataataattataagtatcataaatggataggaaaagttgttttctttggtaacgaatatattttattaaaaaataataaatatataatatttgtcatttgtttatttttttaaaaaaaaagtaaaaaaaaaaacacagagtatgccgccatcaagcacacaaatgtcacgtaactgactaggccccacattttgtagaaaaaagaagggccccacaaaaaacccatgggggcggctatttctcattagtcaaaattttcctatataatctctcttcaccctttctccattttcttcatctctgtaacattttgaattagctatggcgcctaaggaaaaaattggtgcagttacagctatggcaatggtgaatttaaatggaatttcgaaagaggtgcattatagaggtgtaaggaagaggccatgggggagatacgcggcggagattagagatcctgggaaaaaaagtagggtttggttaggtactttcgatactgcggaggaggcggctagagcttatgataacgctgctagagaatttcgtggagcgaaagcgaaaactaattttccgaaattagaaatggaaaaagaggaagatctgaaattcgctgtgaaaaatgaaatcaatcggagtccgagtcagactagtactgtggagtcatcgagtccggttatggttgattcatcatcgccgttagatctaagtctctgtggatcaatcggcgggtttaatcatcatacggttaagttcccgagctccggtggaggttttaccggttcggtacaggcggtgaatcatatgtactatatagaagcacttgcacgcgccggagttataaagttagaaacaaatcggaagaaaacggtagattacctcggtggtggtgactctgattcatcaacggtaattgattttatgcgtgttgacgtgaaatcaaccaccgccggtttaaatctggatctcaactttcctccaccggaaaacatgtgacatcaccagagacgacgatgaagacgatcggagatattttgcgagaaacatttttaatttagtacaagttcctttttaatgttttttaatttaaacagaaaaggaaaaaaaaagtatatagaattagatatatagatgatagaaaactgaagagccatcgccgttgctgctgccgtcgccgccggcgacgattaatcaccgccgatgtcaatatcaagaagggctgatctatttttacccttttttgcaacagaaaaaaaaacaaatctatttgattttgcaaagctgttgtttccattagatcatccttatcatatagttattataatacattgttgccggttttttcagctgaaaataattatcacaattctctatctcattcgattaattcttgattaatcgtaacgagagggagttattcgaatagtaaatatgttcctatttttttgtttttgtgaatcggtcggaatgtgaggagcaggcggcggcgagcgagaaccgctaaaagagtttcgcggtaaacgtgtggcacgtgtggtccatttgattgtacggaaaatggcagatagtggagattgtgccacgtggatgttgtgctgtttattttaatttaaagtatgatttatctttttgcagctaacgtaacaaatacgtacattcagttttgaatgcattacgtatacggatatgtttctttgtttattacgttagtattttttccgtttatttttatttatcaaaaacgtaataattgatatgattattttattaaattatacgatgagtgcgtgagggtaaatttggaactaaaatgtaatgttagctgtctgttggtggatccccgacataaatagtggtaagaatctgttttcgagtaagcacaccggtaattaaagctttaaaaacaacgttaattaatgagaatcacagagaaaaacagatcccttagccgtaatttgagcagtatttaaagatttaagtcattgtgtgtgaagagaaattaaataaatttgttactccgttttatattctctccgtttctatttacttgttcatgttttctttcatatctatttttatatatttccttttatatctgtttttatttacttgtgcattttaacaaattaagaaatgataacaatatttttttctaatatatctttatttaattctagaaaatttctagtactattaagttgtaatgtgtgctttttggaactagaaaatacatttattttacttgggagttacataatcttttaagttagtagtaaaattgtaactgatctataataatcattggtctcttaatatgtgtgtcacttgtaaagtggacaactaaatagggatagagagagtattaaattaatttttgaggtgtttcacgtcttttaaaaagaatagattaagatataagtaaatttagtttttcattttttatttaattattatcaaattcatgattaaaataattaaatattaattaatcactaatttcaatacaaactaatgaaggataaaattaaaaaatattctaaaagtaatcttgaatacaaattaatctgaaaaaaaaaaaatgaaaaatgcctaaaaaattaacttactatgaaatagatggaatactctctctgtccctaatcaaacaaattcttaattgacatacctattaagaaaacaactattgacatagtaaatttgtcgatgcataaattaaaagtttaagatttttaagatattctaaacttttcaaagtaatt

SEQ ID NO: 228 - DNA, 2859 bp, Solanum lycopersicum
aaaaaaaaacagtgtccaaaccgtatatacccaatgccatagaccccaccaaccagactttttttctttttttgccgtgaccttcggatccgactagctgtattcatcggatcttactgtttcaaggtgagtgtaccacgattaatttcacggggctctggagatacggtcgctttgtaatgcctccagtggccctgctggggctcgaaatagcgacctgaaggactttgtcctcaggtctttaccagccgagctacccctcatggttacccaccagacttctttattcttaatcaaagattttaggtatgactttttcacaagtgtaaattatttcgtagagaatgctttactctcgatataaaacttttcgataaaatttaaatttaatcgaatttcaatatgatactgaacaccaaattaaaagccgaaaaatgtaaaatcataaacaccacctctccccctcaatatgtgcagatatataatactactactcatctatagagaacttcaaacaaaaaggtactcctttatagtgacggatctaaaattttcataggggttcgaaaagaaaaaaaaagtaatacttaaaatttgagattttgaaacctcaaagttaattttgaacccctcaactactaaatcaatctctgatcttacatttaagaggttcaaaattaatatacagacataaaaattctttaaaatacattaaatatacaacataattgttcaccgagagagttctctaggttcgcccctactctttcattcttaattagaagtcttaagttcaagttcttacgagtacaaatgacccttattaaacaatatcttatccttaatataaaacttttttacacgaattcaaatttaatcgaactccattacaaatatcaaaataaatgaaaagcaaaaaaaatggcataaccaccctccacccctaccccaccccacccccacctcctcatatatatacatgtgtgtgcatatataatacactactactccatatatagacacacaaacaccttcactagaaaaaattcagattcacagagacataaacacaaacaccttcactgcaattctcaaaatactgcaaaatgacgaaacaagatgaaggattaacattagaactcatacgacaacatctcctcgaagatttcacaactacagaatcattcatcgacagtctcaattcttgtttttccgatcacatctcctcctccgatgacatctcccctgttttcacttcagtaaaaacagagccatctacatccaattccctctcagattcacccaattcctcatacccaaatgaacccaactccccaatttcccgttacttcaatctccgctccgatttccctgaattcaaaatcgattcagataccatcctcagtccagttttcgacagctccgccggttctaatgaagacaataataagaagaagaattacagaggggtaaggagaaggccatgggggaaatttgcggcggagataagagatccaagtcgaaaaggatcgaggatttggttgggtacttttgatactgatattgatgctgctagagcttatgattgtgcagcgtttaagatgagaggaagaaaagctattctgaattttccgttggatgccggaaaatctggtgctccggcgaatgttggccggaaaaggagaagagagaacaagatggagttggtgtagatgactaatttgtaatttgtgttaaagcatgttaattacttaatcctcttctacatcataattaatagagctttcccccccacatatttattaaagaatatcattccataatgtaaattttgattaacaaatttgaattcctaaaaatgataatatgttattatactaaataatgtggatagtagaagcactatatatatattgttttaatttgagaagtctcacaatgtgtttatgttgtatgtataacttttttttacattctaaacaatagttataataagattgataaatcaacaaacgatgtattaaagtaaagatccacaaatattagataataatcaaactcaaaaggcacaatactattagagtaatatcgagactaatagtacaactaagattatagaaaaataagccaaacaacactcacaatctaactaactataattcgaacgtgattcgtatctttcataacctcttatgtaagatcatgttaacgtaataaaatattttacataaaatattttctctataccaaacacattatgtgtatttaactttttacaattagtcctccatcaatcttctactctttttagtaaaagaacttgccttcgagttattattaagcaacttggtataaatgacataaatgttaaataaggctgacaagttaactattaaagagacatatttatgtataaatctaatttaaaattacatattatttcaaacgatgttatatagattgatacaaaacgcaccgaaaaattcagagcataacctattattcatataatatattacttgtatctagttcaagcctatatataaagaaatatactaaatatctgctcttgaactcaattattatcatatctaatattgttatataaaatcactaacttcaaattctgaatttctctttaccgataaataagataagaaacaacacccaccaaaaaaaaatcatacttgtacacaccaaatacagggccattttccaaaagcttcaagttaagggctaattggaccccaagaaattggttcatgcattactactatataagacaagacaatgacaagtttatagatcacaacatagtacaatatatatatatatagcaatgtatatagacaaatttta

SEQ ID NO: 229 - DNA, 2856 bp, Solanum lycopersicum
attcaaattcatcgcgaatgattagtttcattttcaaattattgacattttaaaaaatgtgagtgtttatatatatatatatatatatatatatcagatcttgcacataaataaaatataccccttaaatttttgtcaatatgtagggatatttcaatacttcttttcaattttttattaaaagttttatacttctataaaagtttaaacaccaactttctatattatagaacaaataaataatatatttaaatttagttaatcaaataaaaaaaatacttttttaaacttattaataattcaaaaacgataatcataatttacccccagttcaaaaatattgtggatagttatctcctcattaaacaggatttagaaaaagggaaaaatagaagcaacctagaaatacaactcttggtggaagagataactcatccatcaatacccaacttttttaattgaaaaacaacaacaaaagagacaaacaaacaaagcaaacatcatcactttgttgtcccacatcatttctttgaaataataatattataacatatattttctccgtttatttttatttgtcatattatatttttatatctatagttaaattagtatcttaattcaatatactaaataaaaaatttaaatattcaaaaattatacaaaaaatattatattttatacattataactttttacatattaatattataaaaaaatatcgtaaaatattaatcaaaattttaataatttaattttaaaaataaaaaatatgataattaataatagacgggttagcaatatttaattggtgtacaacagtaaaataaaggtttataaattaccccaccccacatgatgcttcctctctccatcttagaggcctcctaggaaccctcttctcaatcttcaaatttccactctatataatcaaccctcaacacactctttttccactcaactcacacaagtttgaattttaacattccctttaaagaaaaaaatgggttctccacaagagacttgtacttcacttgatttgattaggcaacatctttttgatgaatctctggaccagacttgtttctcttttgaaacaactcaaacttcaaatcttgatgacatcgcaagcttctttaatgctacttcaaaaacagagtatgatggttttttcgaatttgaggcaaaacgacatgttatccattcaaattctccgaaacagagtaacttgagagaacggaagccatctctgaacgtagcaataccggcgaagcctgttgttgttgtagagaacgttgagattgagaagaagcattacaggggagttagacagaggccatgggggaagtttgcagcggagattcgtgacccaaatagaaaggggactcgagtttggttaggaacatttgatactgctgtggatgcggcaaaggcatatgacagggcagcgtttaagcttagaggaagcaaagcaatattgaatttcccactcgaagttgcaaactttaagcaacaaaatgatgagactaaaacagagatgaagtcgtcaggcagtaaaagggtgagaggagaaacagaggaattagtaatcaagaaggaaaggaaaatagaagaagaaagagtactcccaacggcggcggctccattaacaccgtcaagttggtcgacgatttgggatgaaaagggtatttttgaggtgccaccattgtcaccattatctcagcttgttatgatataattttggattataagtatttgatgaatatgcacctgactataaactaagtctgaggtgaattaggattataattatgtgtctctttggatctttaatctttaataatttctttcattaagcgttatttaatgtaaataagcaatcaatcttatatttgttcaatcttataatatagaaattttagagcatagacatttaataggaagcagcttgttcattgcaccaattttattcaaaacaattttgtgtacttgcaagggattaagggcccgtttggatggggttaataaaagcagttttaaaaaaatacttttaaaagtgctgaaacttatttttaaaaaaatagttatacgtttggataaaagtgctgaaattgttatgtcaaacgtgaaaagggaaaaatggaagaaagaaatgttagggttatttgggtaatttggagattgtataaaaatattaagcacaaaaagataaaaatgtggtcaacttaaaacaacttataagctaaaaaaaaaaacacccctaccccagcttttaacttttggcttaaaataaatttttttaacttaaaataagctgttttgagtattgccaaacagctaaataagtcaaaaatcaacttttaagtcagtttgaccagcttttaagctgagccaaacaggctctaagtcccagtgaaaggctacctcagtaaaaatctctttaaaatctatattatgtcgttgtaatcgtaaaaacagcatctggaattataaggagattggagagctgagcctttgacagaacaaatatacgcacgctctatttggatacttattatttcataataaattgtattgtattgtactctattatagatacaatatttgattagtttgtactatttgttgttgtttattaacatttttattatttggattgacgtatagaaactacaactacagatttgatctctttttcttaagaaatctcgattagatgagagatatataaagctacgaaaatgaaaattattattgcataagtaatgaattatttcttattagaagactatttgactagacaggtctcctttactggaggttcccacaaagaagtctatctctggcttgccaaaa

SEQ ID NO: 230 - DNA, 4739 bp, Solanum lycopersicum
ttgtttgattctaaaaatattataaaaataaaaaagaaggaagaaaataatatatgatattgttcttgtgtcttatattaatttttgttttttctaaagttatttcaaaatacttattattttaattaagataaaatgaattagtcttggttcatgttatttataatattaattatctcaaaagttattttaatttctcaatatcttttgaattaagactatcacacaatacaattatattatcctgaatcgaacctatcaaataatgcagtttatattattttttgtgattgtaattattatatgataaaataaatttaatatgcgaaaagtgctcgctcgaaagacatattatagcgacttactgctcaacttaagttatgtctaggaactatctttatcgtactcaaaagtaaatttactgttcaaatttcgcttataaaattgtataaaataattatatgttatctttatttgttcggtatactgtaaccccctgtttgcgattggccttgtagccccgttttacatcttccagagactccatttgtatcggttcacatacagtagcaaagcgccattatcttactctaccccattggcaaacccacagccacaattttccaatcctccattatcccttctacaattttctatataaatacccacatctctctgctctactcccttattatcaacaacaaccaccaaatttcttcttttttttcttcgatagtagcaatctatcaacaaaaacagagaccccatcacaagaatcttggaattttagtgttgggtttaagaggaaaaggggttattgtattttgcagttttgagggtaaagcccagtttaacaagttgtagacatcacggctatacacaaagtaaaccgccgaccacttttacatgttccagcagtacgtcgtaagggttgtgtaacagctactaaccctgcgccgcacggtggacgtggcgctttgccttctgaaggtggtagtccttccgacctcctcttccttgccggcggcggttctttcctctccttctcctactagatatagttatacttactatagatctctagcttattacgtacagttgtatctagtattctattgattattcgaagaaaacacacaaaaagaagtaaagatgatgctcaaaattaagagggttcctacgcttgtttctaactttcaaaaggatgaggctgatgaaattgctgctcgtggtgctggttgtggccggaattgcctcaggaattgctgccttccaggtactgtatactcccttttcccaattgtttgttcatctaaagctgatttagcagaatattgattttgttgttatgtgtttgtactgttgaaggttcaaagctgccactgtatggtttcaaaaatttgagctacggcaagtctgtcgccgatgaaacaaaggaatctccgatcgactttctggaatcccttgttcttggggaagtaagtgcgaagcttcttattttggttactgttttgttattttaaaattgccaatcttgagatattttgatttgattactcacttttttggtcaattttgatgtgcagtgggaggatcgtcagcagaaaggcctctttcgctatgatgtcactgcttgcgaaaccaaggtatttttttcttctctcttctggtttgtggttactgtatttgatgcctacacgttctgctttagttattaccagttagatagacttggtttagaaaggctgtcttggcaaaatctatctaggggactattagaagttgcaaaagataataatctctccgtccttgtttgactcagcacatcccttacaaagtacttaaagggtaaacaggtataacaaaatggaatattatctcttgatttgtcaaactggacaagtaaaagtggacatattgtttttagtatagtagacgagtaaaacatagatggagggaagattataatcacaggaagtgaatagggaaattttgaaacggtataaggtcttataattccggaaactagggtaatgtcttttggaggttaacttggttattgattatgatctgcaagtgatatatagcgttgaaccaattcttaccttaagagactaaggttgacgaagatgtagtcattttatgtcttactattacatagtaaattgatgttatgtagtgtttaaattgaactagcgttttttgtcggtgtgtggcaaatttgaaatgagtgttgtgctattgctcagcgcttgcttttcaagttgttgctttggagacttactgattttgattgatgtgaagaaaggacacttcatttgtgaatcggcaatttgatttaaaataaatggttataggtgattcctggagaatatggtttcgttgctcaactgaatgagggaaggcacctcaagaagcggccaactgagtttcgagttgataaggttctgcagccttttgatggaagcaagttcaacttcactaaggttggacaggaagagttgctctttcagtttgaagcaagtgaggaagatgaagtccagctctatccagatgcgccaattgatcctgagaaatctccaagtgtcgttgccataaatgtatgttcttagttagttttgcacatatactggaaccttttggtaagtagagacagtgattaatgagtttattggttttcaatgcaacaggtcagtcccattgagtacggacacgtgcttttgatccctaaggtccttgaatgccttccccagaggattgacagggacagcttcctgcttgcactgcacatggctgccgaagcagcaaacccttacttccgattgggttacaacagcttgggtgcatttgccaccatcaaccatcttcacttccaggtagagtccacgacacttcccataattgacatggttttggaattgtcagttctagttgtttgctctagtgctgactgctgagaccttaataaagaagaaggaactcactttcattgtttttgctcttcaggcttatttcttggctgtgcaatttcccattgagaaggccccaactcagaagataactgtcactgatgctggagtgaagatatcggagatgctgcattacccagttcgaggtcttgtctttgagggtggaaatactttggaggatttggccgatgttgtctcagattcttgcatttgtctgcaagagaacaacatcccttacaatgtcctaatctctgattcagggaaaaggatattccttctcccacaggtataactctttgaaccacatttttacaactactttgggattgcttaattattagcagttcccaacaattgatcactttcctaacttacatgtgttttggtggattggaacagtgctatgcggagaaacaagcgcttggagaggtcagcgctgaactcctcgacacccaagtcaatcctgctgtttgggagattagtggacacatggtcttgaagaggaaggaggattatgagggtgcaactgaggcaaatgcatggaggcttctcgcagaggtctcactctctgaagcaaggttccaagaagtgactgctctcatctttgaagccattagtctcagtgttgaagagaacgaggacggcactgatggttctcctgaggatctagatgtcacacctccacagcccatggaggagattgatggtctcaacacccacagtaccatggttcccgcctagggttttcacggcccagctctggtgttcatcgcatgttattatttcatgagtttccatctctagctgcccttgtgaaatatcacttaaataaggcaaaaccatgttcaatgtatttgatgaaatctggtctgttcctctgtgaattgaaccttgtgtattattgcttttttctggtataagccatgttctatgtatatgtaatgtggagttggtgtgtgaaatgacccatgtatgctgtttctaattaagacaatactaatataagtttgatttccctatttattctcatcaaactttgtgcttttgatgtataattgcttccacttgaatgacgatagtgcttttgtgtatgtattggagcgggaagtagaattatcactcttactagcacttccctatgcatgctacaaaatattaaagttgcacaaactgcagaccaggctaaatatgttacccacttgcagaagaaaacaaaatttagactaaattgtctaaaaagttgttcccaaggtttgtaacaacttaactaaaccacttataaatgttgtgttaatcataaacacgcaactcttttaattgaaatcaaaatacaacgaatagaaagataaacactctactccgtcccatattaattgtcaaactaactataaatagttgtctcaaattagttgaccgtctaccaaaccaagacaaaattaaataataatctccattttacccctacaattattgtttttgagaacctaaacaagcttataaagctccaaaaagtttttcttttataggagtggataagggataaattactaaattacccatcctattccaggatgtgtaaaagagaaaatagacagctaatacgagaaatggcatataaatgtacagttgagataatgctacaaccaaacattggtttgacaagcatccactataaaatttataattatatttcactataacgtaatttttcttcagagttgatttttcatgttagaaattacagtagcagtatgcttaacttcctctctc

SEQ ID NO: 231 - DNA, 15260 bp, Solanum lycopersicum
aaatgaatttttccatgctaaacttatgggattattttgttgaaaacaacttataccgtcattcttttttgggataatgtcatagtctcaacctatgcccgaaatctcagagacacacttatactatactaaggtcctattacctcctgaacttattttattaataattttttacccctttttagcttacgtggcactatcttatggacccaacgatgattgacttttttttcgaactagtgccacatatgctaaaaaggggtagaaaattacatatgaaataagtttaggggtaataggacattagtatagtataagtgtttctatgagatttcaggcataagttgaggggtacttgaatattttcttttttttttcaaaaaaaaagttaataattattataagccaaatcatcccacacatacaataatttatttatcatttagtaagattaggagtagagttaggtgaagtttcatgagtttggacgaaattattagttagtctatagactctatatataaacttgtcataacaaaattaattcacaattaatagtaaggaaagggagatagaaatgttttttacactagtgattataggttcaaatcgttctaaaatttaaaattttcccatttctagttttgattccacctttgagtgaaataataatttaaaattttcatacttctaattctgattccccctctaactaaaataaataattttaaaactgcttaatatttcgaactaatacttccctttcattggagagaagttactcaaaggttggtctaataggctattgccactatttcaaaagaagggtgtatagttgttacacgtgtccagataagactagcttagttccatataaaagccaatgaaataaatgaagaagtattttcagataaataacaaaaaaaagaaagagaagaaaagaaaaacactcaaataactgtatcacaaaattcacacacacaattgggtgatggaaagcacgtgctcgttcctgataaaacactctctctccctcacaacacgcatatattcatttcactcctcactttttttctcgaccctttctctctctaaacctctccattctgtggtggtgatgttgatcctctcagcggcttcgtcttcttcttcttcttcttcctccttcatgctttcttccgcttcgtcttcttctgcacgcattccgaggccgttatcttcattttcaacttgtgtaccagtagtagtaacaactgtttcttctgcagcaacttcgacgctattcccgatttcctgtttcggtgtgaaatcgaggacggttgggattcggaagctacggtgtgccgttttttgtgcttcgaaggtacgtggaatggcagaaatgattgaagatgccatgacagtttctgcttctgagagtcatgagcttccgcagtcccgagacttccttgacgcacgcactggagaaggtttatctctagctattattactttttctttaatttgaaatatcttgtgcattttttgctttctattgctactttcgcttttttcatttttgaatttgaagtatcttgtgcattttgtgctattttcgtgcggtttgttactcttgttctctgttggaatatcttgtgctatttcggtggggtttaacattttgtgcgtattatgccagagactgttgtacacattcacgctacaatgtttgttttctttcgaatgcattgaatttctcaatattcttcacaattaacaatgctgaacatatgaggcgcgttattacatttgcagaagtgcatttattttttgttaatttgccctatgcttgttgctctgaagaaaatgtgttgagcccatagttaaattgaactaatattgcatttagcatggagttaactgtgaattttgtcaagtaataatttctttgccacataaactattgaactctatgtccatggtgaaattaaacatcgttatctaatgttgtctactctttggtttttcctataagtcctatcaaatagacttgtagtacatcagttccattctaggagatgaattggttggttgcaatagcagtttcagtagtggtattaatgaaattggtgttggcataaggttgcaataagagtacttatctgtgcaagcatgcttaacagtttaaacatcaagtcaatgagttcttttaaccttgatgcaccgggtatagtatgttttgatctttctagtaatctatggtgatatctattaggacggacttacagtaagctcaacgattgttttatttttaacggtgaactggatgtattgtctatgaagcacgtcagttggctttgttgggtctaactttataagggacttctcgaatggatagttagcagaactacacttgaggaatggtgctactataatgtaacaccaatccatcttgatggaagttctcgttaacctgtggatggtgaaggactcgacaaatttatagtggatgggatgatgggaatgatatcaattgaagagtaaggtgaaatgattaggaggtggaagatcttgttatgaacaccaaatcaaacaggcagacaagcaacagtggattgttaaagagaaataagacgcttattggtttctattcactttctgctttctcttttgccccccatttggtgtgaaggatttaattgctgtgaggtagaatctatagactagtttgcattcatggagattctgtaactattccaaagagatgggaagttcgagacaattgaggttttttcttgaaattggaagcaattactaattcatggtaggacatgtactgatgtacatagtaaaaacttcattctcgaattctctgagaacttatgttgataattttttagcagttggttaggcaacaattatttttcatagaagtactcttttgttttgtacaacaagctttctctagactgtgtttcatatttgacatttattatggacacgtgaagttttgatggttgattctggaatcaccaatttgcatattcatatttgggacattgaagtcaccaattaagacaaaaggatcaaattttgacattttgtggtagtatctcgtttttagctttctttacaaaattgtattgctatacagtatctcttgctccctgtctttacagtcaccattcaatctctgcctcccttcatttgactgcttttttgtctaccgctatgcatgcgtactccattctattactgatggttggtgatgtatagttggttccttctctggacatacactaggttattatggtaactttagcttggttaagtaatgcttggcagtttctgcattttttttaaatgtatagatctcctcttgatcgacaacaaagtcattacttcgtatgaagcattcgtggatcttagtttcaagctagcttacacttcattttgtcgtatcttaggatcttagtttcaagctagcttatacttcattttgtcgtatcttacaagtctcagaacctatgcaggtattgtaaaaaacatgacctagttggatcttttttccgataacgcgtcacctagttggatcttgactgacataacacacactcatactatgtttgcactttgaatgtggtttcttattcatttgagaaacagaaacaaatacgatgctgaagacttatgtggtttgtatgctattctgatagattttcgtttcagtaagtagtttagaatgtggattggaagcttagttttctttctgattttggtcttcaactccttttggatcttccttattgctttctgggggatttcgattttcctggtaattgtcatgatgtcgtaatcatatactatcttaatacacgtaagtgtgccacagtggcataagggggattacctatgtaaagaaaattacataaagcagttaaagcactataaactaggtcatctccaatgatataatcttatatggactagaataggattttcagcaagaagtacatttaaagaaccgtgacttagcataaatgttaaaattattgtacaaatgcggtcttaagtttcttgtaaaacaggatgaggtataaagttgtgattctcagaatgcttcctattagactttaatggagcagttttccttcttttccatgacttgtttttctttttttgataaccacggtgtctgagcacaagtacctggtaactgtgcctatcaaggattggatatatggcaaaaagtcattttttgaaaattaaaatatggctgaaaatctggagtgctttttttctgtctttttggtaaacttggtataatcttctcctttcttttttcttttcgggctgtggcttgtgtcttgtgccttgacagacatctgaagcagttgtcaaccagcactgtctgtcctaggggctggtcatctacatgaaattttacaaacttggtctttaaaacatgtcatgtcttagaggttagtcatctacatgaagtcttacaaagtagggtcttagatacatatcatcttgttggcttatatttttgacaggtgatatgggatcagggatgagtgcagtatatgttgcaaggtatatataaatatttgtcaaggtaatcagatagcttgagtcttatacttgtcttatacatgttgtatacttggtacttctttgggatttgaagtatctcataggttttttcgtggtgtctagtttcctttgaatacttgtatgcttcaacatttatgggtgcattaccatatggaactatttattgatattaattaccaatcaacaagagaaaccgtgaacatctgagtaagggttggtattgcaagttatagttcaagaatagcggaagtgctgcaatattctagaaaacttcgtcttaaaaggatttagatacctactcagatgttagtggcagttgcaagtataagacatttgctgccgattcttatctactcatcctgctatcttttcagttgcaagtataagacatttgctgccgattcttatctactcatcctgctatctttcagtgtcttgattctattgtttgctaaatttaaacatactgctcagcagatgattcccttgttcttctgcggggactttattttggtagatctattctaattgttctgattgaacctgtgtctctctttcccccgtgcattgggtgttctattttctgtgcagacttgctatctgctgttcgaaaagctgtggaagatgaaaaactgccactgaatgttgctgaaggaatggaggagttgtatcagaactatcagaatgcagtaaaacacctttctttgaacttgtggttaaatgtactcttttaagtgttgggtcatgggtgctttgttcgcttagatatgtttgctcatatgcaagagtcttcttgcatgaacatactttctgggtcataacatgctttcttaagttactaaagaacagtatataatagatttaagatggttgagaatacaattaaataataaacgtgtgctctctctaatggcttaggcttttagatgagatggttacacacttcaacaatgatgaatattttttttcttctaatgtatttgatcatttgaatttagtggatggtattatgtaactacacgctgttggtataaaaaaagttcacgttgtacctataacagtagataaaacgctggagctggaaaagctaaagtggagagagaaatcacaatttggcatgccattacttttttgtgaccaattatgtggaaagacattattacggggccaaatgttttcagaaaatgacctgaagataataggttaagcccttgtgaagattctaaatgtagtctaacattcaacacgttcagtatcatttcttcctagagcatggaaaatatgatcttgtgatgacaaaacaataataaagataaatctagaggaggtgcttatatttgtatgtttgtctttgcctgatttttccgcacgtgtctttcttgttcctacttctctagtatatcttattttcactaataaataataactcgcctcctccttccctctttcctactaaattttagagaatttcatttatttcattcttggaaagactactacttttggacttaccatatttggtgaagtaatccaatctatcttttagacttgtcagattatcaatctgtttggatttaatttattcatgatactcgtgcgcttttctttgagagagaacgagtttgttgagacctggagttcggcattttcttttttgtttatttggagaacttgttgtggtcatgtgccctcttgatttttcctgatcgttttttataggttttacaaagcggcgttcccaaagcagatgaggccattttgtataacatggctcttgtattcgaccgtgtttttgtggatgtgaaggtattcttctgccgtgttgatctttcaaattcatgctagaagtttcccctatatctttgtttctcgttacttcatctaagcacacatgtattctatcaagttgttagaatgtaaaattgtaaaatgtagcaatgctcttatttcaggatccttttgaattctcgccgtatcataaggccattcgtgaaccttttgactattacaagtttggtcaaaattatatccgccagctagttgatttcaggtgagtctcagttctctctctgtagtgtgtatcatgtaatagtttgactaacttaaaaaatgcgcggttctttcaatcttgttaatgattgaattcacaggaaatattcgagtaaacagcttaaaatatcctttgatttacatccttttgtcgttgtaatatttgcttgttcagatcaacgtattcaagaccaggcatgctctatatgtcgtctttataccttgtaaataatggaatgatgtctatatagatttaggtacagataagatggtggctagttctagtacatatacaaggtggtgggtgaatatatgtgagaataacttgttggaatattgggttaagagcagatagtaaaactactgaaatcatttatatctctaaaggggaaagggcttatgtcatgttagaataattgttctaaacattaatggccagcagaaaatcattttgaccatattgatgaaagggataactaaatcttttgcaattacgtatggggaaaaatatttttgttattaccctaattattttttcattgtagtttaggtataatgatgctattttctcaattggttgggaaaatcccaatttctttagctgaaagaaagagctaagctgttgcactattctgatgaatagttcatcatcctctggtgtctgtatattatttttacccagtgatgttcttattaatgcctcatagcaatccttaagtccaaaaagtatgacgcgattcaaaatactgggtgtctaacaatttaatatccattcaatcagaccttattacattgattttatgatctaaatatggatattttgaaaacaacataaaaagtatccttctttcatgatctaaatatggatattttgaaaacaacataaaaagtatccttctttcaaagaaggatactttttaagtatgtaagaaacctcctgaaaagaggaataattagtacttacaaattgaagtcccgtagttattgtatgaacaacctaatcaccacactaagttgatttctatttgactgtttagcagctagttaatctgtagcattttgacgagttgtgtgggttgagtcaccaatgaagcttagcccatgtgtaaaattactattgtgtagggatatatttttctccctccgtttcaatttatgtgtcttagtgtggctggacacgtgttcaaggtagggagattttttaatcttgtaatgttaaactaaagatataggtaatgtatcaaaatgattttgattcttgtgttcttaaacatgctatgcaggatgtttggaattaaagagttaagcataccaaaaaggaaagtaagacgcattattttttaaagtaagacgcatattttaaaacaaagggtgaagttgcacattgttgagtagtggataggaattcaaaatttgtaattcctatatatgaagtatgatgttagagggttgtttgtcttgttctaggaactccctgctttaactcttaacaggggtgtttgcgaacaatatctccattattgacagacataccgttgctattgaatatttttaatcagctttagtgagtgtatatcaaatgtggttattagaaattgatctttctttggctctttgctttaaagtgaacagccttgttccctgcagatctcatgatttacttcggaatctaacctctactattttcgagtttgtaggagctcttatgttgggaatatgtcagttttcagtgaaatggcagagaagcttaaacaggttcggcatttcagattgttaagagtgtttctattgattagtttcttctgtaattatgctaactagtttctgggaaggtgcgttgcatgtttatcccttgatcaagtttagcacatagtgatagagttctaattcagactacttatgaaaaaggttgaaggagtagtagtctctgtttccttattttcttttggggcacacaaaaagttcctcatcatatagatgatcaagtggagatcgtagagaattgtatgttttgtagattctcaccttttggtataccttttgcatacaactgtttatggtcatgtatatgaacgaaaatacttttacttgataaaaaatttaaaaaagatttcttaacaagctattgcataggagcgaggttttaccatgtgcataccaaaagggtagaggctgtgggttccccttgtcataaaaaaatgaaaaaattccttgattcatcaagcaatgatgtaagatttttttagagcttattatcaaaatttgagcttaacatgaccttgctttcagacccccttacgcgaagatccatattttcttcttattcgccttactggatgaaccagataacttttcccgatttccacgctattcagcagtttccttgattgggggggcgaatgtacacaagactttgtaatcctcagctttaatacattataagagtgaacctccaaaagatggtagaaactctgaagtaggaatattgacatatttcatacttccgaacttctgtcatcttttgtttggtggtttgtctgtcttattattgaaaatatttaggtatctttctcattctatgcgttttgtcaagtgaagttacttgcaagttatagatgtatgtggcttcttgtccaccaaaattatgtgctcactatttatactggagttacgaataacagtcttggctcaaaatgttgtgggtggaccaactatctctatatcacctgcgcgaccactggtttacgcctaaagatcttcttgtaaagttgaatatttttcttcgatgctgtataacactaactacagatggagaactcttgagtgcttactgtacccttcatcccccccccccccccccaaaaaaaaaagagcaaaaaagaatgtcactgtataatttttattctctcttgatatcattttgttagttcatttactgttaataaatctcaaacttagtcgctgatatgcttacccagttcttttttgcatggctttttacacattgccttgatcatttttcctgttgcctttaccaaatcactatttctgtatactaatttcagggtgataatgttgtcttgatgtcaaatcatcaaagtgaagccgatcctgcgattattgcactcttgattgaatcaaagctcccagatattgctgagaacattgttagaactttttccaccctcttgcacttcataagatatttatacctgaagtagcttaattcactagattatcctttactggtaacagatatatgttgctggagatagagttattactgatcctctttgcaagccattcagcatgggaaggtgcacttagatagcattgtcagagtatgtacagaaatcaccatttacttagacatttgacaaacttaatatgtttaggaatctcctgtgtgtttattcgaaaaaacatatgaatgatgaccccgaacttgctgagatgaaaaagagagcaaacacaagaagcttgaaggagatggctttgctattgaggtacttattctgctattgctttgtctttcttggagtattttggtgaagcttttacttaagaagttttgatgtcacacagtattttatcctgcgccaatctctcataaacatttttctgccaagtgttacgaaaaaatgaaagactcgctcttctaagctctacatgtattgaatatgattaaatggaaagctaagcctaatgttgcatgtgtactcttaatcttccctacctatcagaaaatcttgtttgctcaggcgtgtaatagttctttcacgagggggttaaccctgcttgattattctgcatggaagaaaaccatagagcaagtcacggtagaaatgacttctaacatgaatgtgcagaagataatacagatacgatagatggaagttttctcatgatcatggatgtgaaattcaatcatcatccattatatgattgctttatcagtttcatacttcaagtcctagtaaactgttggtatagttagcacaataatggaagaggaaatcaaatgatacatgtttctttggcaattcgagatagctcacaaatgctctttttgatattccactattgctcttttgatggaagcatacatctgaggatacatgtacttgtgatccaggggtggatcaaaaataatatggattgctcctagtggtggaagagataggccagaccctgttacaaaagaatggtatccagtaagattcctttttctatttaataattatagttgtctttccatatatttatcttttcattctatttgatggacatacctgcaaacatggccaacatacatttctcgacaaggtattttctccgtttcattcatatgactatgtttgtacagaggagggggtttaatatattaatttgactctgtatcttaatagtggcagtataggaaatattttaaatagtggttcaaaagttagttttatgaagaacactgaaacaaatttgatttcttggaagtcgtataaaacaataatctaagtggagtggtgaaaacattttgagaagtcccatagttgaaaagctaccataatttgaaggaggaagtgttgctaccttattcattcttttaagtgattcttaattcctttgtgggctgatttgctatccctgcctatgaaatatagggcaagcctcatacatcttctgaattacatctgatgccagtttacatcttaagattttcttccacgacttaactgttctgttcttgattgcttccatttccttggtgaggttgttcttgactctttaagagaatagtcatctgcagccgtgtgctggcacatttatgattcagttctcagaatgtgattggcattatttgcctgaactttaaatgagagttaactgttcgtatccaattgggatttacatggatacatgctatggttcactgcttcttcctattctgtatgttcagcaatacacttctccattacacttgccttgtgacagttctagggtgatgttgataagcgtgataatatctcttcttctccagcatagttctatgtatatgatgggcagttagtttcaaaagttttggtatttatgcttcgtcatgatgcttaattaagagccatttttttaacatttaatttttttttccaaaagagccagatccatataggtaatatcagttagttaagacgcagctaattatttttcaatgaacaggtgtttggtttagataaaccataattgcctttaaaaggccaagtattatgcattggaatgaaatgggcctgaatggatatagaggaatcatataacagattccaactgatctgttgattaattgattttgagcagcttgtggttgaacattttgcttgtatttcttcaggcaccatttgatgcttccgcgacagacaacatgaggaggcttgtacaacatgctggtgtccctggtcacatttatcctctagcaatattgtgccatgatattatgccccctcccgcccaggttggtcctgtgtcaattatgtttgtttctgtgatgactatgtttttttacatatccctgcttgcgatagtacaggttgagaaaaatatcggagagaaaagagttgtatcttttcatggagctggcatatctgtggcacccaaaattgattttcatgaggttgctggtgctttggaggaccctgaggttagtttttatgggaagtccactttggtttaatacttcaaattattggaagcttttcttaaactaaatttggcagcctaatgagaggtttagtgatatttgttggtgaaccttttgggggggggggtcattctatttaatagagaatgaaggaggagaagggaagttggaccaaactctttctctttcctatttgagacccaaatgaacagctagttgacctttgctaagaggggcgcaggttcagcagaaattttgattcctgcagttgagctttttcttgttggaaaagttaagaagtaaagctccaaaggaactttcaatatgcaaataaaacattcatctaatactgttttgtttatttattttttgtcaagttaattctataaactgaagaaaagatatgcatctacaagctctctgaggatagttaaatctgtccccaaaccataggaaaagaaaatgaataaaagatggaaattttgtgatactttttttccttaataataaaattagatagagaaaccttcccatgtgcctaaaaagaaaatattgtttccatgaaattcaaatgaatgatgaactagcgaagagtgttgaattatatcggataatataaagctacctccacaggtgtaaaccgacttatttgggtgtcatctgtgttttctccttatattttaagctacctaagctgctgtacttgatagttgtactattaatttttctacctccaacgactgtagtatcagttttctgttgcaaaattcttctcttcccagatcatttcagatctttagctcaaacatttttcttttgcctctcttttctatcattaatatataaagaagatggttcaactaatttcactgcccttacaaaccttaagctcaaacattttccacttgcgtctgctttctactgttcactgaaggaaatggtttcaccaattcagtcttctttcatttcactgcaagaattctctttaatgttctattccatggggttttcaatcttaaatcgatgttccatttcacagccaaatatttgcatcttatttttatgagatgctattggaactctttttttttcttctccccaatcccctccctcctcccaaatagatgggaaatgcatcatggctggtttgatcaaggaaatgagagatgaatcgaaagctaaaaaaactgcacaccgaaaaattaattgcatataaataaaaaggatcttatgagtaaatacttttcttgatgcaggctaagatggtatatacaaaggcaatttatgattctgtaagccagcagtataatgtgctaaattctgctatacatggcaaacaaggactggaggcttcaatacctagtgtttcattgtcacaaccatggcagtagcttctcttccaactttatttttcataccttgttgctgtagtcaggtatgtacttcaccaaaaatgatctgttgacaaaatttaaactggaacaattggcttcaatccatgtatgtctgattcttgctttgtcggtatatattactagttttgcagatgtttgtttggcagttactatcaaatcacaaggattacactcacaatctttccacataccacgcttgcatgtggttagtctctgcggaaagttgatacaaacaaagtaattcttgaagttacagcaaacataatctgaaggatttttttttggcagggttagatgattcttttgacacgaatgtacagttgctttacattgtatttgtatcaaatgttagattcaaatttgttagtaatgatagctttcaagtactgttatgactttctaaggtttagtgttagtagctattctagattgctgctcatcttacctttgaagtggtaatccaatttgttgggaaatataatatttgatgctctgctacagttgtgtgcgtgtattgtagtttctataagcgttagatgctatttgatgcaacatttgacagtattgtctcaaaagctcaggtgtagtttctacggtagtgactattaacctatctccttcgattggccgcgtagtgtgatttaacctatctcccactacaacatgcatattccagcgggttctcctggctcattgtggtctctccttttaatttatgttctttgtaaactttctctacttgtgcttccagacatcctgtaaatattttgtcttagtccctttacatggacatgtttctttgataactacctttttggtgtcggtttcaacccaagaaattgttttggtgaggcattacgtatctaagcgtgtcttgttacaacagggtcattttatgcactatgatgaaggcacagcacagaatttaattttttgatcaaaatttcttttttgagtcaggcatacagatgacgttttaaaatgaaataagtactcttttttgtccaattttgaattgatatgtattaaaaataatgatttgcatagtgattttactattttatctttattagttatgatgtgaataagtcgaattttttttattatatcttaatttgtttaaataaataaataattaattatgctaaaaaaataaaaatgaataagtaatcataataccaatttctagcaacaatccaaaactcaaataatatcaaaaaaataaaaataagtcagcatgacatgtgtccctcctgacaacaaaaattacacaaattttgtgaagcagaatttaattcaaaataaagtaaaacgtgccaaatccatctccaccatctataaaaccgaaggtctcaaatcaccgtcgacaaccaccgcttccgccgccatttccacggttacaccgccggaggacgtccgtttccaaaagtaattaaatatgtccactctctacaatcctctaattttcaccattaaaaacccaaaaggcagccttaaacctcacacttcccttc

SEQ ID NO: 232 - DNA, 4753 bp, Solanum lycopersicum
aacacaatgaaacgattagcgacaacttttatcgccgctaaaagttattatcagtagtataaatgtaatttttgtcgcaactgaaatccttgttaggcaacttttttcatgctaaaatttatcatagtcgctacgaaatgtttattttagtgacaaattttattgccgtgaaaaagtttatttagttgccactaaatagattttagtgacattttttgttgtcgctttaagtaatttttttccattttaagttattctttgtcgccactagaaagtatatatagtagcgactaattttgtcgccgtaaaagataatattaattgctagttccctaccaagcagtgggatgagccctcatcccactgattgggaggtaagcattgtagcaacttcgtttactgccgaagatatattagtcgctattaaaagtcagcattcgtagcaaatttagtcgttgctaagaaagtactttgtcaccttgtaaatgcttagaattattaccaactttagtcccgctaaaaaacataaatcattactaaataaaattgtattaataacaactcttgttgccttgaaagtatatatttatcgcctacaaagtttgtatttgtaccttctctagtcgcaatcataataatcgccacttaaaaaaaagcaaaaattagaagcaacgattcatttattataccaagttcacacatttactttgacgtctctgaaagagcaaaattgacttgatgagtgcaaatgaaaaaatcgaaacaagaaaaataattatctctttcttgaccttctaattaaagttaaaagaatatgttttttactatggagtaaataaataatcaccataaagcatcaagactaagccgagcgttatcgatactttgccatattgggcttcatttatgggctaaaatgactcaaaatagcccaacttgttgagattttaattcatccaaattcagtccacaatttcttcttcttcttcatcttctcttccatggcgaccttcaacatctcatttctcacacaacctgccattttctcttcccagaataccccttctttctcttcatattcacttcccaaaacctcctttcgcttcccttccattactctccgtcccaaaaccagaaccaccactcgccaccatgcgagcatcgttgttgctgctctgaaaaagctttctgaaacagaccctttaaccgtgcctctgcagtctgatgaaatcgctggaagcttcccgaaggaatctggtgtatatgcggtgtatgatactaatggtgatctccaatttgttggcatatcacgcaacatcgccgccagtgttatttcccataagaattccgtacctcagctctgctcttccgttaaggtaaacaactttgattaccgacatttgtaatccctttttaaattcttactattgtgaaaactgtttatttattcgacaaggatgattcatagagctgacccaattaattgagattaatgcgtagttgattgattgattgatcctgtgtgaaatggttgattgagagaaacatgtttatatttcttgacaaaagcgtaatatcaggatgtgtcttggtgatgctatgagaaaactcatttagaaatggatttgaatcagcatgttcaataatatgtgatgtattagtagtggaatgcatactgttgtgagaatatatacgttaaatacactcgtggcctgagaaatgaaatcgattttacttttctttttcgtaaagtggacttgcttccattgaggataagaattttgttcccagccttgctttagcttgtgctgacttgaacaactgaaagtttcctctcaattgaaggggatagctcatatagttagctgctagcgaatgcaactatttttttgtttggagcttgcaaatcgtgagagcgacttatctacttctactaatgatagaagagtgagcagtatagcaccaatattctcattattgttgatgatggttctgatgccacttctgtattgattagcttgatcaacctaaaaaaaaataatcttttgatgactgagaaatctgtctggagctgaccctttaggccaactgctgcctttgcaacttggggatgatggccgccttctacctttttctgcatacataccatagtaagttcgcttggcgcagcgaacaaactgatatataggatacttgttttttggtgcttaaaactgctagagcgggagattgtgctagttgaatgtgcagaggtggtcaacacttatgattgaaggcatttatttcattctaggttacttacctcactgagaatatacctcggccagaaaagattggcatttggtttcgttgctgctgggcgtcttgtagtaccactcttttactgcttcctttaattaacattctttatcgttagaatgtttcttctatgacatagtgcagctgtgaaggggaaatttgacaaaagtagagtaatttgtggcagtgttatcaaaggtgaaaagcgcaaaaatacaatgagatctgttggggctttaaagcaaggtgcaactaaagcgcaagcttgtaactgtaattcaagaataacaattattagcactattgataattatattgacaaaagaatctaaaaattataattaagagaaatgtttattgttaagtgtcgcttctttgagaccacactcattggtgatgaagcgtacaccttattgccatgtactgaagctctggccaaccaaggcaaaatgccagcctattttgcacctagcttcaggacttaagtgagccgttgataactctgctgtgtggatgatgatttatagtgcacataaggcacaccatgctgaataaacaatctctttactttagagagcaaaagcaatatattaattcttggctaagcatgttatcactgtttgaattatgaacattttctgatcttcttattatatgaacgttactttgtcaaacatcacatatactgatcttcttgcttagaatcccaactgcacccattattacttctgttggtaaatttcacgtttgtttctctctttttataattcaggattttacggctatattttttctttgagtacttaataactggtatagtgtttgtaggttggtgtggttgaggagccagatagaaccgccttaactgaatcttggaaatcatggatggaagaacatattacgaccaatggaaaggtaccaccgggtaatgaacctggaaattcaacatgggtacgtcagcctccaaagaagaaggctgatctaaggttaacaccaggccgtaacgtacagttgacagtgcccttggaggaccttattgaccggctagtgaaggaaaacaaggtggttgctttcattaaagggtcaagaagtgcaccacaatgcgggttctcacagagagtggtatccattctcgaaagtgaaggtgttgattatgaaagtatcgatgtccttgatgaagagtacaactccggattgagggaaacgttgaagaactatagtaactggcctacatttccacaaatttttgtgaagggtgagttggttggtggatgtgatatcttgacttccatgtatgagaagggtgaacttgccagcttgttcaaaagctaaaaatgttttaattagcagtaaaaagtgtaagctttattgtgagaattacatttctttgaacttatttactcatcagtgtattggtattgtggaaatagtgcaatagtttgaagaaaattcattgttaatgtgtacaaaagaatatgtcacaagtaccataagagttttttgcatttgtgccggctcataatctaaaaaaaaatcgcttttattaacgtcaagtagcatttcaagttcatttgatatgtgaaaaagtttttttatttttatgtcagttcatgatctaaacgagttacacttactaacatcaataagtagcatcgcaacaaaagatgaagacttatggtacatttgatacgtagaaggggataaacaaagatatctataagattataaatgaaactttgaaaaaagaaattgcagtagaagacaaaaaatacttatggtatatttgatacgtagaaggggataaacaaagatatcttataagattataaatgaactttgaaaaatgaaattgcaatagaagacaaaaaatagcaagtgatatttagggaaaagctctacgtttgtgaggagcagattaggacaaaagctgatggtttttgaaccgcgattcatatagttttaggacggagtcaaaaattgaagtttatgaatttaatttttttagaaaaaaattatcgaagtcaatctttaaatttttattaaccaaattaaattatagaaatactatataatttgtgttgcataacttaatttctatccgttatatatcgagcaaaacaaaactctttaaacttatatcgatcgaattagttcatcaataaaaatactaactttgattcataataatttataaaataaacaacaaaaaaaataatttgatatttaagaacaaaaatcaataaccacaagaaaacaaataccattaagaaaacttatatttttttcaactatttgaaatccgtggcacaaagtggattgccaagtgcctcttcgtatattgtttaaaaaatcattttaatcttcactaaaatacaaaccccttcaacaatttctgtatattattttaaaatctgcacaattaagataaatccaaaatttgagttttttatagtaa

SEQ ID NO: 233 - DNA, 7452 bp, Solanum lycopersicum
ttaccttctcttcttgtaaccttaacctacaagaaactttactaactctactcataatcttacatgcgcctagcaaccgggacaaaacttctcttactcactacacctctcaaggtgataatctctagtaaccctagcttattcacatcaaaaatactcaacaaccttatatcccccttgggagcaagcctatactaattctttttaagcatcacgaatagttcacctcatcacaaaagatgattatagacaaaggtgaattacactcctacccttcgtagaggagtctattctctcaacccatctagaccttactcaaaaaccttattcaatcaatatatcaacatacctcaaaaatcatcatagctaagtcggttcccaccaccaattaataataacctcacaatcaccttgctaggtaggcacactttcgaccctcgggagtaaccactcaattcttctaaacatcttttataacataaaggcaataataaagcatcattcatactaaataaaacatcaatgtctataatctcaaatctatcaagtcacatagccatatcgcaaccaacatttctccctcactccttgaagcataatcccttctaataaacacatactaaagacaataagataagggataagagagagagcttatagatctatgacacgacttgaagaatgaagaagtgaaatcttttagacctatgatatgactagattagttgattttaattttaactataaaccgattcaaacccacgaacccccctaaattggtatgtagtcaaccttattcttatttttttaaaaagtaatttgtatataatcttttaatgtgtatatttaattattattaataaaacatgagtgagctttcactcttaccccgtgaattccagtccaaaacaaaattaaaaaagggggtaaattggtaattttttattcacctctaccgtggtcactgcaatttatttattttaataataaccttttcagtccaattttttacctccgccggttcatctcagtcatcatctctctttctaaaaacttcactcactcgcactttctctctctataaacctagggttttttctctacctccatccatggatgatattccaaattcaattgatgcatagcatgtagtgtatttatcatcggagtttgatttcattcgacctcgacccgaatagttccggtttgaggtaggttttatcgtgaatggagccgaattcttatggcagcgggaaggctgctgtcggtgacggagtaggagcgccaatgttgcagacggcgccggcgccggcgccgatacccagtgcgaatgcgccgccgccgtttctggtgaagacgtatgatatggtggatgatccgagtacggataagatcgtgtcgtggagtcctacgaataatagttttgtggtttgggatcctccggagtttgctaaagacctacttccgaagtactttaagcataataacttctccagctttgttcggcagctgaatacttatgtatgcatttctttccttttgctttttattgggtttttgtcaactataactgatccaaatgcttaatgaagaatcgagactaactagtttgtttttgttatcgtgatggctggatgattataacttcttgtttgatgttgatggtgattgctaattggaatgctaaaagaacagatttttgtaaataaggaatgctaatgttttttcaaccttgggataaaatttaataaaatgtgtgttgaattagagaatgctgttctggaggcctgctatttgttttgttatgaatatcatgtgcattgttcttgtgccctatttcctcaatgatccatttgaggacatctttgagtgttgcgccttccgccctgcaacttatgtttttattatagctagtgcagtccaatttaatgtgtaaattgagtttcaatcttctactcttagagcacagatccaactttttgtatctttgcatcgactgggtgccttaataatatttcgcttactacataaacgaaaacatcttttactctttaagatcaatataggatttagtttcccaaagaatatgaacaattattattaccagtaaaataaaaagatagtgaaaaattattatgttgtgcttaatgtgacccctgtgactttggagtggtaagatcacaatatctgatttgtggattaggcgtgtcaagggtcggattctgccggtcaaaagcctgatttaagtagatcacggtagttactatagatggccaggctcactatccactgagtttcgaactttatgcgaccaatccttcagaatttcttggttataaaaaataaaggtgtgttcttattgtgtgatcaagtagatgatctatcaggaagcatgtatatatcttgaccaataaaactgatcatgggactgtcaatatctgcatcaacatttggacagtggtaacttgtattgttatcactgcggttcccaaatgaagagggggtctaatatagtagcttcaggttgatgctatgatgtttaaatatctttctccctattgcacctcatctgatttcgactaaattaggttcctgaccttgtttccagtactttctccgtgtaaaaggtggttgttttgccttttgtggatttgaaggttgggaaaggtgttaatctcctgtgtagaaggggtgggggattctagcgtatatatggagccatttatctattgcagggactcatcaaagatcccgaagtgagttatggaagtttggaggaagcatatagacaaatttgggaatccatttagaattttcttatattataattcatatgactggaaatattatcatcctaatacgtttgggtcttactcttactagattgctaatctctaactctttctttgtcatcccaaaaacccctcacatttcccttcgcttttatcttgtcagtaaattcttccatcatgtccatatcacctttctgaccttaaaactttcactattcttagaaaacttacccacctatataactttatttttgtcttccagtactactttttcacctgccatttttaatcatcatattgtcctccctagacattttacaccctcatgaaatattcctttaactgtcatctttttgtgacattttcgtctcctcaacgctttctcctcttcttaggaaatctcctttcaccattgcatttctatcaactttttgtcacttttttcctgggacttgccttttctcttcccaagaattttttgttctgtcacatatctatcacaataaaaagaggagaatgaaatagctcaggttaagcctttgagtatttggcatttccttaacatttgttcttctatgaattaaggaaaaccattgacgaagaagagcttttaccataactcttagtaattccaaaggaaggaaaaatgagtcttaggaagacaagaagaggtgattaagcttaggaggttaatttaatccaaaggacccaaaggaaaggtgtttgacattcttcaagcctcatgtaaaacacagttgtctatctgatctaagtatcagaaatcagtcaaagcaaaaagaacgaaatcatggttgacatcaaaacaccagtggactctagtttgttgtaaatttgttgtgagaccaaatgaaggctgcaatttagtgaagcatgatctcactggttttcaatatttgtatctctctggttttctttgaggttatgaacagaagatctttgtagaactagggtttgggcatagaaccccgagtgttaagctcttttggtgtgactatgtgacttgtggtagaagagcaaaggttatctgaatctatttcgttccctctcttttgtgatataaaggtgatagagatgtgatagtgaaatgaaaaaaattgagaagaaaaaagagtctagggaagacaaaaatttgagccgaggatgtatcaaaaacagtctctgtacaccacaaaggtagggaataccctaccctccccataccctacactccccagatcccacttgtgggtttacactgagtatgttatgttgttgttgttgttatgtatggtcagtttcttatgtgaatggtcctttgctatcctttcgtggctatatctcacttgctgttcactttaatggtaattcctgattattaaagtgccttgagtgccaatgttgtgctaatgctttggttcaatgctaaaggtagtaaagcctgggacttgggtaggtgcatgtcacatgtttggaacgtaatattgggttgttgtgacgatctctatctgttctgcttgcgtagagtttgtctttttccttgacagaagaacagccttcttctccaaaaattttcttatctctcgctacatctgtgccttcttaaacttttgtaaaaccttgaatgcttctccacctctttttacttttccttctctcttctcttctttttgaggtataaacagcaccatcttaatgctgttctgacgtcagtctattctgaagtaatgcttactatttccccccaaaggggtatttatctaggaaagaatttgcaattatgggttttgtaaccatgaggtagatgcgggagcagttacagtgagttggatatgatttcacttatgcttcttgtttcgaatgatttctttttcttgtcctatgggaagaggtgcttgtttatttgagacctatgtgtacgcttgttgtgggggtgtatttctgaaacagttcttttattctcaaatcatgctaatttttcaccgaaaagcttatatgaggaaacaaagttactctgtgaagtgtggttggatatttgagttgtttattgatttctttctggttgcaaagtaaacctgacgagtgatcttagtgaaaaacaaagccacttggcaaactcgttgttgattaattgcctttaattcaaaatattggcgcagtgatctttgtactgtttatcaaacttctactcatgcctttgtgggaatacagggttttagaaaggttgatccagaccgctgggaatttgctaatgagggattcttaagaggtcagaagcacctgcttaaaagtataagtcgacgtaaacctgctcatggacatgctcaacaacagcagcagccacatggaaatgctcaacaacagatgcagccacctggacacagtgcatccgttggggcttgtgtcgaggttgggaaatttgggcttgaagaagaggttgagaggctgaaaagggacaagaacgtgcttatgcaagagctggttaggctcagacaacagcagcaagccactgacaatcagttgcaagggatggtgcagcgccttcaaggtatggagctgcgacaacaacaaatgatgtcgttcctggcaaaagctgtcaacaggcctggattcttggcacagtttgttcagcagcaaaatgagagtaataagcgaatagctgaaggcagcaagaaacgaaggattaagcaggatattgaatcacaggatccatccgttactcctgcggatggacagattgttaagtaccaacctgggataaatgaggcagcaaaggcaatgttgagggagctttcaaaactagattcatctcctagattagataacttcagcaacagtcctgaaagtttcctgattggtgatggttcaccacagtctaatgcatcttcaggtcgtgtttcgggagtcactcttcaggaggtcccaccaacttctgggaagcccttgctgaatacagcttcagcaattgcaggtcaaagtttgttgccagccacttctgagatgcagtcatctcatcttggcacatgttccgaaatcatcaacaatcaattgtcaaacataatcccgttggtaggaggtgaagatttgcatcctggttcactttctgcatccgatatgattatgcctgagttatcacagttgcaaggaattttgcctgaaaacaatacagatgtgattggatgtgattctttcatggatactagtgcagttgagggaaaagtgggactagatattattggtagttgtttgtctcctggtgctgatattgactggcagagtggtttgctggatgaaatagaagagtttcctagtgtgggtgaccctttctgggaaaagtttctccaaagcccttgttcccctgatgctgcaatggatgatgatatttcaaacacaagtgaaaccaaaccacaaataaatggatgggataaaactcagaacatggaacatcttactgaacaaatgggggctactaatatcaaacaacaaaaacatatgatctaatctctatatgatatatgtacacaaatgttaattatggtagtttctcgactttagcttctctatagttactatgtttggttcgtcttctttcttctcttgttcctgacatgaaactcaatgtacctaattaatcactgaaagatctgccctctcttctatacatcccatatcccttatgccgtagggataaccagggcctggcagctgcacatgtattcatttttttctttcctttttaatttattttaaaaaaaattaatatacaagtggggataaacatgtttgtctggctgctgcacatgtatttaatttttatgtgtttaaaaattgcataaaaatcatgataattcacaatttaaaatatttttttgaataaatttatcaaatttttaattaaaaagaagttgattgattcataaaattgatctatcttgtcaaataaaattgaacaaaaaagtaacatgtattatttaatttggaaactatgcaataaatattgtaaatctcaataattgattgactcttgaaattatgtgttacgtaacaacttaaaattttataaaaatcacataaaatttttattgactctctattatataaagtaagacaaaaataatcaggttatgttttggttttttcaaaaaaaaggttacgttttggcagtttctttagtagatgggttttttgtttcacattaaattattctactcttaccatttcaacttgttggattttctggttctatgtttgctttgttaaaaaaaggttatgtttgttgctttattgtttatgtataacatgaatagtggcattggttggtttaaccacaagtgaaggtttctgagtgcacgaagttggaatatgggggttgtccttctcagaatgtatacaagaaccactgtcttagcttttcttgcaagtgttcgacaattagctctagttgctcagtctagggcctttggcattttcaagaaagtgctgaaagagtaactgttaagaagatgaattaaaagagtaaaaactccattgaagagtatggttgagaggaacagagaagtaatgaggaagaaaagaaaaactgatttcttgaataatgattcaatgcatacattgccttatctataatcacatgctatgactaacctcctctaactagcttact

SEQ ID NO: 234 - DNA, 2946 bp, Solanum lycopersicum
tttaaagaaaatttattaagaaatatgtccaaaactctaaatattgctttaaaatggaagagtattcgataaagtcggggtaagagaaacataatttcgaagttgaccattaacatatcttagaaatggttaattggttaagtcctagaatatattcacattttttttatttttttaaaatatataaatgcccttttatttggtttcagttaacatttatgctctctaatttttttttatactatataagtagatactcaaaatttgtctaaataaaaccaatagatatgcatgtcttacatgacataatacataaaattattatgttgaatgtcacgttgcacgaatgtgtctatttattcattttttaatcgtaggatgtcaaattaaaaaaacaagtttatgtgctgcgagaaaaagaaatcttactttgatttttaaattctaaaatataaaacacttaaacaaaaatggaataatgcacaagtactcctcaatctttgtccgaaatctcagagagatatttatattatactaatgtcctattacccacttgaacttattttattaataattttctactccttttcggcgtacgtgacattatcttgtgaatcgaacgctgattgattttttttaaagttagtgtcacgtaaataaaaaaggatagaaaattatttataaaataagttcaggaggtaatagaatcttaatatagtataagtgtttctctggtatttcgaacatagattgaggggctattgtgtttttttttaactctactgagaaaataaggggtgaaaacataaaaatggtgaaatagagaccccatttttctaaaattatagaaatatacgatctttcgagaaagctggagtttagccttggcaatcacttcacagttttatctataactttcacgattcctccacactattctcattttttcttataaatacctccttctgtaagcaattaaaatcattcacaaacaagaagatttctactttctgtgattaaaaatctaaataactataatggcttacacaagtcttacatcttctccattagtgtcaaatgttagcgttggtggaacctctaagattaataacaacaaggtatctgcaccttgctctgttttcgttccgtcgatgagaaggccgacgactaggctggtagctcgggctaccggcgataacaaagatacgtcagtcgacgtacaccacagcagtgctcaaggaggaaacaaccaaggcactgccgtcgaacgccgtcctacgaggatggcgcttgatgtttccccttttggtaagtccttcccctgttttttaacaggtactagtagttgcagcatttaataaatttgttacaattcgtttagtaacgataattgtttcatgtgatgaacaggagtgttagatccaatgtcaccgatgagaacaatgcggcagatgatagacactatggacagattattcgaagatacaatgacatttccaggaagaaacagagcatcaggaacaggggaaatacgcactccatgggacattcatgatgatgaaaacgaaatcaagatgcgtttcgacatgccgggactgtccaaggaagatgtaaaagtatcagtagaaaatgacatgcttgtcattaaaggggaacacaaaaaggaagaagacggaagagataaacactcatggggtaggaattatagctcttacgacactcgtttaagtctcccagataatgttgtgaaggataaaatcaaagcggaactgaagaatggagttcttttcatctcgattccaaagactgaagtggagaaaaaggtgattgatgtccaaattaactaacattcagaatcgccatgcttttgttgttctaggttcatttgtaaccttgtgtaaaatgtatgttcgcatatgaatataaaacaagtagtgcatctttgacaaggggctgctctgagacttgttttctggcaaattacaatttacaaccatcaagacaagtaagaaattaaataggctgaataataaacagccatatagaacaaaggaagagattacactcctttttaagtttgaagttggaacttgctcagaagtcaccgttagcagtattggtactcgaggcattgcctacagagacataaatagctagcaataccataccaaacttaaattacatcaacataagcaaactcacaaaccagccaacagtacaagagtatcaagaaggtgagagatgccgagttgagtaacgctaataaaccaaaagacaaacgccatgaggtacacgatggtatctgtatctacgtatatattaaatataagatcagatggtgaatgcaaagtgatatattactgcaccaccgagcggggagtgcgcggccggacaggagtcttcgatgggcttactctgcagaatagaagaagtctcaagattaatggaaatgtcagtaaaatagagaaaaaagtatcaccaggaatcagagagcaaccttatagggagtgatcccaggattgcaccactgcagttcagtgcagcaatggcactctcggcctgcaacaatcggaaaattcatcatgaaactacactaagaaaaagggaacaaacataataagcgatacaatggagtgattcaaaattttctacttagaaacacatctgccgtcccggttttaggtatatcaattattgacatcataacatgccagaccaatgcaaactaatctcgagtaagaagcagattgagataaattcacagcatgtctgttcccttaaaatgtaagcaaagggcctaggaatagatcttcccaagacaacaaggaacaagcaagaatgaggtacttaacaccaagaaagtttgtcatggctaacctagaaacaaattgcacctaagctaatcacaaggagaaagtgaactgaagtgtgggattctcctatcca

SEQ ID NO: 235 - DNA, 5422 bp, Solanum lycopersicum
ttaacgagaattttaaaattaaattatgactaaatatattaagggaaaaagagtagatatatcccgaactattataagtggtatgcaaatactgttcgtcatacttttgggacattgatgttcctgccgtcatatttttgggacatttggtgcccatgccactttgttagagtgaaagggcatgtatgctttaatttacgaacgacagggacaccaatgtcccaaaaaaatgacggaatatatatgctaccatttacgataatttgggggtatatttatctttttttccatacataaatgtgccatttctttcgatatatagataaaagtatatcataaaaatagaacaaaataagtattatatatattaaaaataggagtcaatataataaattaatattttcattttaatttatgtgtttgacttgatatgaaattttaagttttttaaaaatatttatggtctaaaaaaagttctatatatttgtattactattaactattttattaagaaaaatataaatttaaaaattaaattattactctaccaaatataaaaatgtacttcctgtttcatttaatgaggtatacgttcctttttaattcatctcaaaagaaaattactttagtataattgaaataatttaattttaaattatagtgatttactattacataaatgattttttaaaaatactactccttttgttatactttgtatgatgtatttttctttttagtcagattaaagaaaatgatatatatttacatttaataataattttaaaatatttattttatttttaataaaatgacttttagtccacacttacttgagactacaaatttcaatttctttttctaaagttttatacgaacgcaaattaaattatataaaatgaaaaaggataatatattaaaattaaataatatcacgtaaaatgaaacgggaggagaacatatttttacataaattctgggagagaggaggtgtaatataatgatgataagagtctgagtgaaaacgtaacattcgaaggagctataaagtgtcatctctagaaaagccatttctctttttccctctgctgcttacgtcttctttcttctttgccttcttccattactttctctacctttgaatctaaccaaaaaaaaaaaaagaaatgctctcaagagttaacagtatgcaggtttgggatatggaaggcaaacaagaagaagaaaaagaagaaaattttagcaacaaggagaataccactaatgttgagcttgaaaacaaacaagatatggaattgggtgcactttctacattcaaatctatgttagatggtacagatgtagattggtatcacaacaacatgcaaaaccatactgaaaatatctgtttcactcagaatttcactgaattagctgaaaacagcatgtttctacagccagtagtaccagtggattcttcatcttcttgttcaccatcttcagtttctgttttcaacaatctagacccatctcaggtacattacttgttagcccaaaaggctattaacaacaaccctttggattatagttttaatttgggttgtgaaaatggttttcttgaagctcaaggtatgggtggtttgaataaagggggatttcttcttgctggtggtgggtttcatgatttgagctcacagaaccaaatgggtaaccccaatttgaattcatttactcaatacccatcatcccatttgccccaaaatactactactactgggtttagtccactagggtttgttgatggttctgcaaatgagaactctctgtttctcaataggtccaagttgttaaagccacttgataattttgcttcaaatggagcacaaccaaccctttttcagaaaagggctgctcttaggaagaacttagctaatactactggtggcagtttgggggatttcggaggtgaaattggccagaattccatgaatggagagaatgaaaggaagagaaagtggggtagtggggaagaacttgatgatgtgagctttgatgggtgcacattgagttatgattcagatgaccttactgaaaatgttactaataaggtggatgatactgttaagaatggtggaaatagctcaaatgcaactagcactgtcacctgtgggaatcagaaaggaaagaaaaagggacttccggctaagaatttgatggctgaacgacgacgtaggaagaagctaaacgataggctttacatgttgaggtctgttgtaccaaggattagcaaggtaagatattttttacatcaagttctcgtgatttcctgtataattatattattctaacatgttttagcttattcaaaattgtcagcctttagcttcctttcccaagagaatgataaagaaaaggcgaaatcgaaatagagtgttattatttcttcttttctgttttgaatgtacttcatttactcttcttaaggtatgcaactttgtcctgtgcatagttcaaaaaagttttctgtattaaagttatttgatagtcgcattaaattcattcacatgaactatatgaaagatttcaaaaggatcttctattttggaccacaaaagagaatagacatcactacattgctgtaagtatttcagtttgagcggtaactcttatattctgttttaatctcaattgtatatatctgcttcaacttgttttcttcgcccccctctctcgcgggggaggggggagtctgtttgctgtcccaccacttctcaaacagcttggattattgtaaatggtcataaatactatgctttattaggagtgtcaaagtttattgtatggaaacaacatggtacttgaattttagcactatcatgcggaaacattttactggagccctaagaaaccaagacgtaggaagttatctttgatagaccgtgatgctgaaagttatctacctattagttaacatttgcgtcttacttgagatttaatcccaaacaaccattggacttgattttaatcttcctgactacctaatataaaaagcttcttcttggcatgcaatttatgaatacgcatgttcacagatggacagggcttcaatcttaggggatgcaattgagtacttaaaggagcttttacagaaaatcaatgacctgcataatgaactggagtccacgccacctagctcttcactgacccaaacaacaagcttctatcctctaacaccaactggaccagctctgccaggccgcatcaaggaagaactctatccgagttcatttgcaagcccactgtctagcccgactggacaacctgcaagggtaaaaagtctttaaccaacattaacatttcatccagaaaaaacttattataagacgagatatacattgattgcattgagcactattacggtgttcttcatggtggtaaagtctaaaagtcatcatgttattggtttgagatgatgtaatgcggattttgttttacttttaggttgaagtaaaggcaagagaaggaagagctgtgaatatccatatgttttgcagccgcagaccaggcctcttactctcaacaatgagggcactcgacaacctcggactggacatccaacaagctgttatcagctgcttcaatggatttgccttagatatctttagagctgaggtacttgattttctgtttaattgacaatgttggactcttcgattgaaaaatgcttagcagaagttcatatatagaaaattgaagtcgatcaatcccgcaatgcacatccttctggaacgaacggaacctaaaaccatattaagcttttaacatgcgaacgttgaagatacatcagaagagaataatataaaaaaaatgtcttaccagcagacaacagaaaaccttttagaaagttagtagtccaaattactcatggtaagttgtggcaccacttcaatgagctccaccacgactgcgtagattcttatctgttccctccttgattgagtataccagtctgtctccctatccagaaagcacgttttctctttgcttgttccgatcagtgttggagaagaagaaaataggagttaaatgatctgtgatttaatttggattgttatccttgccaattttatgtgcatttgaagtgaattcttctttagatgatcatttttgtttgtgtgatctcagcaatgcaaagaaggtcaagactttcatcctgatcaaatcaaagcagtactgctggattccgctggttgccatgggatgatatgagcttctgtgattgacaaagggaaacaatgtagccacaactttcaactttagactcttcttgttgttctagccaatttcctatgctcatattgtatttctatatttcatccagcaggctgttgttttgttttacaactcacaatttgctattccatgaacctttgcttccatttatcagttacttagcgaaccgattaactagcagttttctcaattgtcctgcagttttagtgtataaaaagcatatgcaaggaaaatttggatatgtcaatgaaattcactcattaattctgatattattttgatttattttccaccttgggatgtcgtgaaatagttgtactgcattcaccctcaactatacatccaggttcgagttctggaaatggaaagttttccgttaactactggatggttaaaccaaaaaagggaaaatattgaagggtaatatctaggcttgtttttgtacatatacagagcttggtcatctttattgggggatttaagatgttcaaagtgctgcatttttcttcaccaggcaaacaaaccatagatggactgcatgcataaacttttgatctgctaagacatggaagttctctcttcaacatcattattattattataagtttattgttctgtcaaagaggttttcattccattacaaaaaggataacacatcttctaacaagagactcaatgctgcctcctcaaggtgatatcaacacaggcaaataggtcccaagaaggtttcaagctgctcatatacccttttgacgtcttgacgattcggattggattggactgctgcaggagactgctatcatagagacatatgtgacttccaactacaaaacaatgcaacaaaaccagagtatgatcaacacgtctggcttcagttttacatggcgaacacaatcaaacggcttaagtttcttacccttctggcacgctctggctgagatcaataacaaaggtgcgaatttccattggggcgagctctaccatcagctttgtaggatcaacaggtccccctcttgccacgtctcgcaaatcactaggagcctctgctttccactttaatctcttcttctccatttctactctttcttggttggcagataaactcatctctctaatcttgtttatctggaaaaaatgtttaaaaggagtt

SEQ ID NO: 236 - DNA, 4439 bp, Solanum lycopersicum
atttgaaaaattgatcaccgcctgatttgatgtatcgtgggatttttcaaagagaatatagttttaaaatgtgtaaattgtcctttaattttcttgtcaaaattaattgttggaaaccaaagataataaatcaaataatgcagaagtagttaatctagccacttttaaaaaatccctattttttttattacaaaaacaataatacaacttaaaaaaaagatacaattttataattaaagataattcaattcgatttcaatttttagtctttcatacgagtagcaaacaagtgattaaattgagtttaaatgaatcaagagggactaaaacactaaatataaaaattatcaaaaaaatttaaaatcttatcaaataagtaaatcataatttataaataaattaacaaaaaatcacaagaactattttataattatatatttgtgattacatggctcataaaaacaacaacaatagcaactagttaatttttaatataatatttctacatgatacaaataatttattcacatcgatcttgaataatctttttttacaaaacataaataacaagtctatttttataaaatataaaattctcaaaatgtaaatttttagatcaaattagtttaaaaacaaaaaaaataattggaatttgaaatcctattttttttataacttgttcggagaaagacattaatttcgaattataaacttaaaattaagatttcatatttgatacaataacacttacttaatctcatgattttaaacggaagcaagccatgttataacgtattaatttatttccttaatctcgtgatcttatacaaattacggaggcaagtcatgtcattaacgtattaatttcgacgtcgatccgtattttggtttagaaaaaaaagaaaagacgtaattgagcaccctcgttaggggtagaaatgtaacttactgcgcctcgttcctgccgatatctcggaccttttttatctctatataaaatgcttgattccttctgaactttgtaaaactaaaatacattttctcttcaaattgagctttttctccattaaaattctctctgcaaatttatagtttttcttttttcactttttgagaagaaatcaaaagctatgtgtggtggtgcaattatctccgatttggtacctcctagccggatttctcgccggttaaccgctgattttctatggggtacatccgatctgaacaagaagaagaagaaccctagtaattaccactcaaagcccttgaggtctaagtttattgaccttgaagatgaatttgaagctgactttcagcacttcaaggataattctgatgatgatgatgatgtgaaggcatttggtaatttctcctctcatctgttctttttttcagcttctagtaggtaggagttccttttagcttttgaaattgttaccatgattttctgaaagtgtgttttttatttgcgtgtctaaatacgtttcatgctctaaaaatcacctcgaaatgatttgattcaatgatattaggaaggatttttggtctgacctaacaagcttgagttggttaatgtggtatggttcatttgtagaacttaatttagttttaagtagtattttggtgttgaatatactgatttaggtgatttggggtttataatcgcggtttcgattgatttttcccctttttagtatgtgaatatacatttaagaggagaaaaaagataacttttgggtataggatgtttgcgaattgtaaaatgaagagtaagatgctgttgttcttcctaattggtcgagaatgaatattttaggcaacagcgcatcctaagtaatttatgcaattgcggattgtgcttggtgcccccaaaagagtcagagatttttggatcatagtttcctaatttgaactcaatttgactgtgatatggtcattcatatagcagattttctagatgatgaactctgattctctggatgataaactttttatctccggagaatgtgctacgtgatgttgatagctaaagagaaataatttggcgtaaataacagcagagaacatatttttgcatgtattttgatcttgatttctctccttagttatgatcactgatagataactttcgaataaattgattttggttaccttagttttgatcactgatagataactttcaaataaattgattttggtaatctttagtactagtgatataaaagaacctgcttttcgtgcgtattctatgtttctcactttcatggtatctgtttgtcaatttatctgattgattgttccaaattttggtcatttatgactaactgagatggttaattctttttaaattctaaaggccccaaatccgtgagatctggtgattcaaactgcgaagctgacagatcctccaagagaaagaggaagaatcagtaccgggggatcagacagcgtccttggggtaagtgggcagctgaaatacgtgatccaaggaaaggtattcgagtctggcttggtactttcaattcagccgaagaggcagccagagcttatgatgctgaggcgcgaaggatcagaggcaagaaagctaaggtgaactttcctgatgaagctccagtgtctgtttcaagacgtgctattaagcaaaatccccaaaaggcacttcgtgaggaaaccctgaacacagttcagcccaacatgacttatattagtaacttggatggtggatctgatgattcgttcagttttttcgaagagaaaccagcaaccaagcagtacggcttcgagaatgtgtcttttactgctgtagatatgggactgggctcagtttccccttcagctggtacaaatgtttacttcagctctgatgaagcaagtaacacttttgactgctctgatttcggttgggctgaaccgtgtgcaaggactccagagatctcatctgttctgtcggaagttctggaaaccaatgagactcattttgatgatgattccagaccagagaaaaaactgaagtcctgttccagcacttcattgacagttgacggtaacactgtgaacacgctatctgaagagctatcggcttttgaatcccagatgaagttcttgcagatcccatatctcgagggaaattgggatgcatcggttgatgccttcctcaatacaagtgcaattcaggatggtggaaacgccatggacctttggtccttcgatgatgtaccttctttaatgggaggtgcctactaagctgcatacacatcttcccttgctaagttttgtaaataacgcttcatttgagtgaagtttgcgcctgcgtttacgtttatcaccaaactaaaagactatatatgtgttgtattaatttattcaaaatttactcgtttgatatatgtaagtatgtatccttgttttcataagtcaatgtcttattttcttacagtcacaaagcatatgcctttcgcctctgttaatgcgttggcgaaggtaaaactaacagattttgaattttgcattttactgatacatgatgattaactaaattgtattgtttaatttacaattgtaagttgctgatggatcattctcttaacaatcttgtgcttaagcttatcagaaacagtcattaagttaggtaagctagactgtcacaagcttttgtgcattattgatcaataatgtcaattcgccagaatttgtggcaacattatattcactttgattcatttcatttcatgtgatattttgtagattttgaaattcaaatagtttatcgtaataagtttcacgcgtcttatcattttttcttcgaaaatttcgtattaaatcaaaatcactctgctatataaattaagacggaaggtgtattattaagtggaatacgtactgccctttgagatcataaagagttgtgccaactccaggaaagatgatgagccgactgattttaatttatcttatttaattgtttagcaattgaaacttgttaatccaactaatttaaaatggtatcgtcgagaattcattacaaagaaaagttttctcaatttgttagagtcagtggagctagaaatattgaggggataaatataaataagtaaacacaaagaaataagaaattcgatattaactatatattattaaaaataatatcgattatatatataaaaaataatagtaatttatatttaatcatatatcatacttgagtaatatgtgagggtaaatgagacaatttatccataggggtataattggaaaggggaaggcggcttatggctagtggtgatagtggggtctaatttgtttggagatgtgccccaagtggaaggttcagttaatcatttttttttgtttttttcatttaatatatgtgtaatatcttaggcctaactctcgtcgtaaaagctagttcttagggcgtgagttaagtttaaaatttaatt

SEQ ID NO: 237 - DNA, 4166 bp, Solanum lycopersicum
acattaatttagaataaaagttttaaattttgcaacattaaacgctaaactcaaaagtatatacaagttgaattgtaataataagccaatttcactcgaaaaatattgtatacaaaattaaatatatttttcaaattttttactattaatttgtaggaaagaagaaaataaaaacacacgtttacaacataagatgataatccctcaatccctctagttcacattgagtagattatttttcagagttcaaaataaatcaatttcttttatatgtctacgtaattatttaaaaagaatttatcatccttctttatggagtttttaactattttaaatttactactagaataatttaaaaataataagaaggatcataatgaaaaataaccttcctgaaatactttttttttcaatgaatgtacccccaaatcccaacaatccacttaacatgaattaaatggggtgctaattaggatggagcctctctcaccccatatatttttctattttttcgatatgaattgtgatgaaatgattaaagactctttcattcttaattatctttcaatttaagctttacatatgaaaaaaaacaaatattcaaaatgtcattttcaaaaataaattttactatatgcaaattcaaattaatcgtaatagacgctcagtgatcgatcataaacacagagagttaggtagtattgtcaaatttattttcataacaaaaaatgtagggacacccaccccttctccccacacccacatgggtcatttgttgtattagtagtaatatatagtagtagtaaagagtttaatcctccaaatatgcatttttcacatatccaacacgtggtcttctcttacatgttagaagtggaccataattccacactctccccaactctatatatacaaatcctccccttctctcttctataaactcaactcaaaaggaaactaaacataaactctcctcatttcccacctcttttctctctacaaaaaaaaaaatcccctttccacaacaccaaattgtactattaacatccaaaaaaaagaaaaagaaaataggtagctatggcaactactacttcacatgccacaaatacatggattaagactaagttgtcaatgccatcatcaaaggagtttggttttgcatcaaactctatttctctactcaaaaatcaacataataggcaaagtctcaacattaattcctctcttcaagctccacctatacttcattttcctaaacaatcttcaaattatcaaacaccaaagaataatacaatttcacacccaaaacaagaaaacaacaactcctcttcttcttcaacttccaagtggaatttagtgcagaaagcagcagcaatggctttagatgctgtagaaagtgctttaactaaacatgaacttgaacaccctttgccgaaaacagccgacccacgagtccagatttctgggaattttgctccggtaccggaaaatccagtctgtcaatctcttccggtcaccggaaaaatacccaaatgtgttcaaggcgtttacgttcgaaacggagctaaccctctttttgaaccaaccgccggacaccatttcttcgacggcgacggtatggttcacgccgttcaattcaaaaatgggtcggctagttacgcttgccgtttcactgaaacagagaggcttgttcaagaaaaagctttgggtcgccctgttttccctaaagccattggtgaattacatggtcactctggaattgcaaggcttatgctgttttacgctcgtgggctcttcggacttgttgatcacagtaaaggaactggtgttgcaaacgccggtttagtctatttcaataaccgattacttgctatgtctgaagatgatttgccttaccatgtaaaggtaacacccaccggcgatcttaaaacagagggtcgattcgatttcgacggccagctaaaatccaccatgatagctcacccaaagctcgacccagtttccggtgagctatttgctcttagctacgatgtgattcagaagccatacctcaagtacttcagattttcaaaaaatggggaaaaatcaaatgatgttgaaattccagttgaagacccaacaatgatgcatgatttcgcaattactgagaacttcgtcgtcattcctgatcaacaagtcgttttcaagatgtctgaaatgatccgtggaggttcaccggtggtttacgacaagaacaaagtttcccgatttggtattctggataagtacgcgaaagatgggtctgatttgaaatgggttgaagtacctgattgtttctgtttccacctctggaatgcttgggaagaagcagaaacagatgaaatcgttgtaattggttcatgtatgacaccaccagactccattttcaatgaatgtgatgaagggctaaagagtgttttatccgaaatccgtctcaatttgaaaacagggaaatcaacaagaaaatccataatcgaaaacccggatgaacaagtgaatttagaagctggaatggtgaaccgaaacaaactcggaaggaaaacagagtatgcttatttggctatcgctgaaccatggccaaaagtttctggttttgcaaaagtaaacctgttcaccggtgaagttgagaaattcatttatggtgacaacaaatatggtggggaacctctttttttaccaagagaccccaacagcaaggaagaagacgatggttatattttagctttcgttcacgatgagaaagaatggaaatcagaactgcaaattgttaacgcaatgagtttgaagttggaggcaactgtgaagcttccatcaagagttccttatggatttcatggaacattcataaacgccaatgatttggcaaatcaggcatgattgtgactattactgaggaaaatttaccagagggatggtttagaatatacgtccccggaatattcctctttaatggagttcgtttctttgattatttctacatcttttttctttgtttatatagtgtgagagattctcagagaaccagttagtagcttggatgtagttagaaaatgggagctcagctggtttttttctggtgattctttcacatttgattgtgcatgagagagtatatataccttattataggaatacaatacaatgttcctgtaactctctgttttcttgtatatcaaaaaaaaaatcatcgcttatactattttccaccctttctctttgattgtgtttctgtttctttagtttttagcttgtgtttcgttcgatattcatgttggtagatttcgaatgtggtgttcagtattgatactgatttttgtttgtggtttctaatatggtattcaataatgatgtttggttctcgactaactttggtttttttatttggcgttcaatattagtgtttttgtttgtgtcttctttgatttttaatttactgttgcaactagattaattattatctgtgttttcttcttggttattaaatttggttgtcaatattaatgttgatattcgactaatctttgtttgggttatttggttttgtcgctctaataatttttgtgtgtgttttttttatttcttattctagtgttcaatactaatattgacactcgatgatgtttgtttgttttttcttgatttctaatatggtattcaatgctagcattagtatcactactggtacttgattaatttttgtttgatatttttttggcttttaatctagtgtttagtattattagcacttgattaatcaatcaaaagaaaaaaaaagaccattcatatttaaatttaaaaattctaataaaaaataaaataagttcttccaattttttatgtatattaccaccctaaaattagggataatgcccaagtacccctagcgtatgcccgaaatctcagagacacacttatactatacttaggtcctattacccctagaacttattttattaataattttttaccccttttcgacctacgtggcactattttgtgggcccaacgattgttgactttttttttcaaactagtgccaagtaggcaaaaaggggtagaaaattacttataaaataagttcaggggtaataggaccttagtatagtataagtgtgtctctgaaatttcggacataggttaagagggta

SEQ ID NO: 238 - DNA, 3705 bp, Solanum lycopersicum
cagatgattagcctcacatggccttgctgtctctctttctcccacccaccccctaccccataccctccaccccctctaaattggtgctaacatttacctctcaatttattcgatacttttcgaattttgagatttaaataaatttatttttgataaaaaaaattatctacataaaattaatagttattgtgacttataatacgtttacgtagtttataaatatataaacttcatttcaaaaaatttaaaaatttcatgcataaattatcgattaaatttaaactgtttgacccttgaaaatgaaaagtgttacaaaagaaaatatataattttgaattcttatagggtatggttacaagttaagaacataaacatgtggtctattgtatatgattaatatataaagataaagaagtaaagaataccctagcataacaacaataattagaaatcattagacacataacaacatgatttaaagatcaatgaagtataggtcaaaagtagggagtcaagtaaaacgagtttgaattaaattcaagcgaatttaaataaaataaaattaatatataaattattaaggagcattttcttaaatttaaacatattaaaatgagttaatttaatatataaactgataaatgaaatgcctactgctgaaaagaatgattaattttttctgcatgtttataaagttggcctcaaatctacgtagaataaactatgtaactagtacctacaccacctatataatagtacacataaaatcattaatgaattttacatagtacagtaattaaatttaacaaactttataattaagcattagattaataaaaaagtatctcaagtgaagacaacaattagctagaaacaactagaatatgaattaaataaccattattattattataattatgattatcttgttgacaggaatatatcattgtttactcagttaaatttccttaaatacccttcccttatcccattaaaatgtagcacaaattcatcatcttcttcacaaacacaaaaactcaaaaaagctctgtattttttcactgctaaagaaaaaaaatgtcgaaggacgtgattgaagaaggacaagctcatcatcatggaaaggactatgttgaccctcctccagctcctcttctcgacatggctgagcttaccaaatggtctttttacagagctcttatagctgaattcatcgccacccttctcttcctctatgtcaccgttgctactgttatcggtcacaagaaactcaacgctctagaccaatgtgatggtgttgggattcttggaattgcgtgggcttttggtggaatgatctttgtccttgtttactgcactgctggaatttctggtaagactactactttccaattttatgtatccacaattttgtacttttgagttcatgagtttaaaattttttaatacaaatataaaatttgaagtgaaattagtgggtttttcatgaacttgtaagcacaactgtagctccgtccctacctggaaatgggctgatgtatataattcatgggtccaactgaatctgacgtttttggcctgaatgattaatatgtgtctaaagaatcactaaaattctaaactatgggctctagatctctgtaaaaaaaaaaaactaacagaaatacattttttttgatgttgttgttgaaggtggtcatattaacccggcggtgacatttgggttgttcttggcaaggaaagtgtcattgataagagcagttgcttacataattgcacagtcacttggtgctatttgtggtgttggtttcgttaaggcattcatgaagcattactacaacacagaaggtggaggtgctaactttgtgcaacctggttacaacaatggaactgctttgggtgctgaaattattggtacttttgtgcttgtttacaccgtcttctctgctactgaccctaaaagaagcgctcgtgattcccatgtccctgtaagttaccctctcacaacacaaaacttaggaattttaaagtttcaaattcatgtctagttgtaatttcccttgtttatgggtctagtagatctgtaaatagaccacaaaatagtgatttcaatactaactctttaagtaattaatttggatatgaaggtgttggctcctcttccaattggatttgctgttttcatggttcatttggccaccatccccattactggaactggtattaacccagcaaggagctttggagctgcagttatttacggcaacgaaaaaatctgggatgaccaagtaagtttttactagtttacgagagatttaatgttattaacgtatataataaatattgctcatataaattgttgcagtggatattctgggttggacccatggtgggagcaatggcagcagcaatataccatcagtttatattgagagctggagctgtaaaagctttgggatcattccgcagcaaccaaaccaactaaacaagttatcaactttcattcacaagttcaaatttttctggcttaattgtttgattttgtgtatgaggattaattaattaatgtatgaacctttttttattttgttcgttttggtacagtttcatctttaatgttagtttttggatgtgtattttaatttggtatgagactagagttggtggtctattctctttcgaataaatttaaaggtttcatgttattttagcactcaaaatcaccttattgggtatttgttattttccacttgtataggtaccctgtccactaaaacttccacgaaagtcttaatacataacaaccattttataaaaaagtaaatttttttaaactacatgcatttcatgtctatcgtattataattataaagagtgaagaggtatatatagagcgaaatcatacaagagcatgtacatctaagtaaaatactaattatattaatgtattagcacagagccaactacttgtaattaggtgttcatccaaatctaatatatactttattttctatggaacatttccacaaatattgttatgaaggctaattttcttttcttttggtggaaattgaatagtgggcatctatgtagtacccacttaatggaatcatttaaagagcttctttcaaccccttcagatatgtttgagaccattatccacatagaatagtgccacgtgtctcccagatgctcttctatgcttatgggtctctgtttggtgagtctgtaaaattattgcaggggttggcatgacaattgcctgcatcaactccttttgacttgaagacaaacaatacgactaaatcaaaccaacggtaatgaaaaggttaaaaatcatactccattccctctctttaacttttcaatttccacactttcgaaaacagggaaaatcgttatcaataaatggtatttgcttctgtctcaatttatacgacttattcattctattttatgtgatatcatttccttttttaataagtccaaaaaagaacattcacataacatttaaatatacgattccgcttttaacgttgttggtcccactaaatcttattatgaagagagaaaaaataaatttacaataaaagataatttggtaaacatttcaaagtcttcattatatcttaaacatcgagtccgatcaaatattacataaaatgaaatgaaagaaatatttttatattaagtaacaatttaacc

SEQ ID NO: 239 - DNA, 3524 bp, Solanum lycopersicum
gtaaatctaggtaacaaacagtaatcaaccactaattaatttcttaatatctaatccgatctacttaaattaatttaaatcacagaaaacgttaaagtcggttacggcagttcaaactggccgcttctgactgccacgtgtcggtgggcacgatggccgttacgatgggtcaggttttacagcctggcttaatcacagtagtctgctacagttatttgtcgtttactgccagctcatcaccactcaaattttaaaaaattaatttttaaaaaaaaaatggaattaaaagtaagaaaatatcaaagcccatgaaaatgctctacagcctgtcttttagtcaaagcccattcacttcccttataaccgtacgtacacttctcaaaaataaataaataaatttattattattaacttccaaaaacggtcggtgaatttaaattttttatttttccataaaataatttaaccaaaatagttcgtttattttagtttttacatgtccatcttacaatatttaccttaatattttaaataatcgatacaaaatctaagagaaataattaatattgagaataaacatgtttaaaacataatatatatataatatatatatatatatatatatataaaatgaaatgaattatggatatgaaacataatacatatatataattcataacttaacgtcaatggttaactaaacatttcaaatgtattacttactctgttacacattttaatagatataaggttaaattaaatgacatataatgcgtatataaaaccaactatattccctaaatatctaaaaatttccgagattttagaagtgtggatttaaataggtgtctacatcgaacgtttcatttcctgacgcgtgtgtttgccagctgtataagtgtaactgcctttgcttttgattaaccggtcattttcaccttctcaaccggtcatccctatcctttttccttgttcaagtatataaaccccccttctctcccccacaagtcttcgttcagtaaaggcgaggctccgcctcccaccaccgtctaatttgtaaatatattcgccggaaacttctctatccacgctttctctatatctatcataccctttttcttaattaatcggttgctattcctttgatggcagcgattacgcagagaaaagattcggatcggatcaaaggtccatggagtcctgaagaggacgagttgttgcagacgcttgttgagaaacatggacctagaaactggactttgataagcaaatcggtgccgggtcgatctggtaaatcctgtcgtctccggtggtgtaatcagctttcacctcaagtggaacatcgtgcttttactcctgaagaagatgatacgatcatcagggctcatgccaagtttggtaataaatgggcgactattgcccgtttgttatcgggtcggactgataacgctataaagaaccattggaactctactcttaaacgtaagtgtccttccatgtccgaagatttaagctttgaaacccctcaaccgcctttgaaaagatcgtctagtgttggtccctgtaccaatttttcttctgttatgaatccgggtagtccgtctggatccgacttgagtgattctagtctttcgggttttccccaatcgcatgtttacagacctgttccccgtaccggcgggattttccctcttcctcctcctcctccggttaagcagatcgaaattcctccatctgtacccgacccaccaacatctctctgcctttcgttacccggatccggatccggatccatcgaaaagccaacccagtcccctaaatcaccaccactaccaccgcctcctttgccggcggttgataaaccgattcccccatccgtacccgtaacttgtccaccatcggctttcatgggtcatcttgctcaatctaatcaaagttatgattttagtgctgcacccaaatcaggagagaaacagttttttactccagagttcttatcagttctgcaagatatgattagaaaggaagttaagagttacatgtctgggtttgaacaaaatggtctctgcatgcagactgatgcaataaggaatgcagtcattaagcgtattggcatcagcaagattgagtaatccatctatgattactgttgaactgttctatagtcatcaacaatggctgccgctgctcagcgaaatgacaccggagaagaaacaatggaagatcggagcagtcttcctcccccttttttttattgcttaattacttccttagaattccaatcaaaaaaaataattttgcagtaatgtacagatgaatgagaggatgagagaagaaaactaaatttaaaaatgcccgaaaagatgaaaaaattgagaaaaatctcattctcttgtctaatgtcgtatgatgatctcgcttcgatagcgttgcaagaacaggctcatgaaaattaatctatgaattaggaaattttaacatatatactttttttttaatgaattttataaacgtgtttgtttcattcatcactccgataaatcgaatagtttaagattgaattttatacacacaaatgataaaatgatctcgaatgttatggattagattgggagagaagctaagtaggtccagttttgattgatattttgtttggattttcaacgaacaccaaaaatagattcacttattaattattgaatgtggagacagttgtgcatgacttattgtgataactgaaattgtttaattagttgctgaattccagctaatggcaggctgtttagtggggttaattagtcaataaacatgcttaagttgctaagtttttgtgataggatggttaggcaattgctgattatagtgggttaaaattaccctttttgtttgtggttgtagtggatggatgcactattattatgtgttagacacagtacaattttataaaaataaaatattagtggaacctaatctagttctgaaaaggaacattcgagaacatggggaaattatgtgattatataacaagtttggtgagaatgacatttcaattattgacttgtagtttaattttacgcggttcgttcttgaaacaaggatttattaggcatttgattgagatattgaacaaataaattgtcgttcaattcttttactggatatgttattggaatctagccttgttgataaaaaaaaatagctgggagctaagcttgagaacaatttgaatgattttgttaggttatcaactaacagaaatgcagaatcattaatttattattgactataagacagttgatcatggcttttaagatttttaattattactgaatttgtttgctgatctatccagctattaattaggttttagtcaaaaaaaacatgctaagtttgtttattactcttttatgttgttatgcactatttgttagggtgcttcaggttgaaggtttgccccaattggaattatctttgatctgttatcaatcatattaatttgaccatcaggtatttgttactcactt

SEQ ID NO: 240 - DNA, 4957 bp, Solanum lycopersicum
gcctaggttgtatgatattaaaatgtgtcactgatgtgtaaggtctgtctacttatatacatatctcttttatattttgcagatgtgcaacttatcctatgctgaaatgtcacaaccaccactttcaaggtaaatatggagaattttgccaactgaatttcaaggcacatcaaatataataattataaaacttaatttcgaagaaattgagcttaaactctaatcatgctaggaaatgaatttgtggagaatctcttttctacaacaatgaccattatctatcaaatgaggtcatatggagagcaaattacttaatcaaattgttcttgcggtttttgaaggagctcaatgcctgagtttaatcatgttactattataattgaagaatgtaaagacttgtagaattttcatttggtgaattcatgagcttttataagcacaagacaaggataaacatgtcaactgaaaagtagaaagaagaagcacttcaacagaaggtagaaacacctaattcaagtgtacatgttgttagagaagacaaaagtcttgagatcaaattatactgtcacctatatgaaaaaaaaattccacaaacttaacccatgaaaaaagaaatagaatcacacgtgatggggcttattaagaatacaattaaataacaaaagtatgcactctctaacaatttaaatttttagaagaggcgatcgcatccttttaacctaatgacttttgagaaaggaatccattttcataactattctaatccacctttctacaacattcttatccatgattttcttctacctacaacagtggaaaaagaagattaaaacagaaataaatattaaggcaatcttttggtattaggccaaatctatttgagaaaaaacttttggaaaagtagttgctgacatggacaaataagaaagggagaaaatagtaccaaaagcacttgcctttttacttttagtttttgggtacagaatcaaaaaaacaacaaacaaaccacacacacctaaaaagaacaaaaacaactctcccctccctcaaaccaaatgtatcaagatttctctattgccacatacaaatttgtggctacaaatccctctacctttagtgatgtgtctacccccaccccccaccctctaaaaccctttttcttcttctcttcatctatagtcctcaaagtccaaaacttataagacaccaaacatcaaagaaacaaaacaagaagataaaaatttgttcccatcttacccctttttcaagaaacacaaactacttttaataaaaataaaaaaaatcaagaattgtgaagaggaattcaagaaaatgtctgaagttagagatccttctattaagctgtttggtaaaacaattggtatgacacaacaagaaaccaattgtgtttatcttcatgatgatcatacaacctcatcccctctttcaattgatgatgaaaaggtaaatctttttactgaattgtttataaatatatatcatgagttaataaaaaatgaatttttgatcaccaattttagttataaagtttgaaactttatctttgatatatctatttgaccataaaatttgatcaaaacttttaaaaatatgatctttttaggacttatctcattttttttcaagtaaaaattcaaatttttgagtttcaacttcaaaatctagcgaccagacagagttttagtatgtgggtgagttttgttttatgaaaagattggatctttattaataccatagcttaaaatggaaatgtaaaaaaaaatcagttttaggaaagaccctgttttgggattattttttattttatattttcaaattagataccatagaactatgatgtttcttgatgtttgatctggtgatgttaatcaacatttaaaatatatatatatatggatatgatcttactttgcaagatattttttttatatgtttttggaattaagtatgttaaagtagtgtaatttggaaagcacaaggattatatgccctgaaatattcagatcgtgagggtgtagcggaaacagtctctctatcctaaaaagatagggtaacgtctacgtacatcctacactcttcagatcccacttgtgggattacacaccgggtatgttgttgttgtaaatattcaaatcctgtcttgtaacacttttgtattcatgatgatcatattgttatgtatttttatcaagtggaattgttaactactgctaggaatggagaattagggctaaatattcggatcgtttaccttgtcgaattgcttatgttaaaacgataagatggtcgttgattcggtgaggaatagttttgatttgttgtgtgagagctcgaactaaacctgttttttcttgtcaattgatcagatcaatttagaaggagaagttacacaaagcaaacaagttgatgaacttgttgatccagctgcagactcgtcgattgaaccagaaacatcatctggtataagcgatgacatcaagatgcaggacgcagataaagagacgttatcctcaaaatctgtcgaggaggaggattcgagtgaggagaaggcactcaagaagcctgataaattgattccatgtcctcgatgtaatagcatggaaacaaagttctgttattacaataattacaacgtcaatcagcctcgttacttctgcaagaactgccagagatattggactgctggaggtacaatgagaaatgtgcctgtgggatctggtcgtcgtaagaacaagagttcttccatatcgaattatcctcttcaagcaggtcgagttgaagcagcagctcacggaatgcatcttcctgcttcaaggacaaatggaactgtccttacatttggatcagataaacccctttgtgactctatggtttctgcattgaacttagctgagaattcacataatatgcatcgaaatgaataccatggatcggaacaaagaatgcctacaatcgggaatgatcaatcaaatggaagttgtagtacagcttcaagtgtaactgacaaagaaagcagtgctggtactcatgatttagctaattggagtaatttccagccatttcctcctcaagtaccgtactttcagggcgctccgtggccttattctggctttccagtatcattctatccagcagcaccgtactggggatgcaccgtgtcaaacccttggaacgtaccatggctttcatccaatcaatcagtccataacaacagtcctacttcaccgacattaggaaaacattctcgagatgaaagcaagcttgatccatcacaatcaaggagaagagatactactttgcaggatagagaaggggagagatgtgtactgattccgaagacattaaggattcatgatccaaatgaagcggctaaaagctctatatggtcaaccctaggtatcaggaatgagaagattgattcgactcgtggtacaatgctcttcagtgcctttaatccaaaagctgatcatagaaatcgcgaacttgacacttcttttgccttgcaagctaatccagcagccttgtctagatcacttcattttcgtgagagtacacgatgatacaagacttacaacatgattcatggttgcctagtaccaatcattcatgttaagtctcttgcataaatgcaggataaagctgcatacaattgacctttgtggactggcccttcctcggaccctgcgcatagcaggttcttgtgtctaggaggagaaggagacagtatgcatagtgtctacaaagttttatagttttgcagtactatgtgtaccttgtacatagacctgtagagttatatttaatagatagagataaataagatgcagctgaagttttaacttgacttctgatattgatagttttattctgaatatttgagttatttttatgatagtatatcaattatattaatggactttgtacttcttgtaaagattcacttttcttggctaaggaaatgaaacctattacactctcctaatactatggtttcactcttattaatatctatgttagctcgaatcctccaatacgctttcgatctcatttttgaaaaacacctgaacaacataccttatgttaaaagtaaagaacatcagagattgttgtatctgacaaaagaacatctatttctacacaaaaaaaataaaaataagtcatccgtattaaatatttataccaaatcaagcaaaatttatgttttttcatataaacacttattgtgtaaccgcaattaagtgatacatgttctcactttaatttacgaccactacaattaaattttttaatttgatacaaacatcatatacgaataataaaaaaagatccattctaaccatcaccaccaccaagtattagcacatgagccacaaatcatgataattattagggtaaacattataaaaactaaatagggccaacaaacaaacagctcattgagaaaaagagaaaattgactacaaattggacattttaggaagaaaaaataacataagtacatggtaggtcccccaaattttgtgtagataaactagaactttttttttcttgatagaaaaataaaaaaagttgtcaatgcacctttcactttcatggcaaaaaggatctattcttaattccttacatatgctaaaaaggtgggaaaattcgagggtaaagttctctttttcttcttactttttggtttctttttccaagtatataactttatattaataaccaaagagagataaagataataatatatggttattatccattagttgacaataaggtagatatatgtcatgatttgaataaaaactatacattaaaaatatttaatgttggaccagttgtatgtttcctgactgttctttcaaattgagacacaccaatattttcattactcccattagctttttgaaccacatattttctttaaaaatgtgttgct

SEQ ID NO: 241 - DNA, 3022 bp, Solanum lycopersicum
attggactagtgaaattatatttaatattttattatcattattcgtttagaataaataaatgaggcttatttatttttaaattagagaaagtaggaggtggcctttcaccaatataaggagatgggtcatgttgtgattttaaagtggagcacgtgttaagggacaaaggtataatggttgcatcccatgtatgtacaaatgaaagaagagtacgtggatgattttaatttacaagctataaataactacatttaagaacatggacttttattgagcttttttgggaccctttttagcatgatagtgactataccttcttgttggttagttttctaaaataatgctttgggactttggaaggttttcatcttcactaatggaagaaataatgcagtatggaaaaaaaaatattccatcaatttcattatttttaaattaaaaatagcaatgctatttttttcatgttttattgttaatgacgataaaaagttcatatattttatttgaaattacaaaatatgaactttttatttctcttaaactcgttgtccagaaaaattctggtatttaaaatgaaatatatggagtatattacttggttaaattaaatgtagttatgataatcagttattcataaaaaagtgagatgaactagacaaaaaaaccatgataggttacctattcaaatacgctaataaatttagaagtactttacagtttacacaatcaatatgtatattttaaactactttaaatcatttttgttagtattaaagatgcattagtagtggttggttaatcgtcaattcgtcatccatatttttaatagaaataaagtgttattttaacgttcaaagtaaatcgtacgacaaatttaataacctaaacctaatattttacgtattgtttgtctatattacagacgttctttgtaatttgacaagtaataattctctacacctgacatatataaatatatatattaagcttgttcagaatgtatgataatgaagtccatttctctctgagaaaaacacactccaatttcctctctcccaaaaatacttcaatttttgtctttttccatgtttcattcccattcttctctaaagtagaaattgacacatttgattatttttttctcccctgttttcataaaggaactcttcgatcctaatatattaatacagtatgtcagaattcaattgatcataaatatttctctttcttctcaacatccatcttataataattcgtatttataattataagattaaagttaaggtatttactattcgaggaaattatactaattaaatgtcaaagcgaataagagagagtgatgaaaaaggtaataaacacccaatttatagaggagttcgtatgcgaagttggggaaaatgggtgtctgaaattcgcgaaccgcgtaaaaagtcacgcatttggctcgggacttatccaactgcagaaatggcggctagagcacacgacgtcgctgcattgagcataaaaaaggactcatcgattttaaatttccctcacctaattgactcattgcctcgcccaatttcactctcaccgagagatgttcaagctgctgcagctgaagcagctgcaatggaggatctaaattatgtctcttctacatcctctgttagttcaattgacaaaatcacgtcggcgtcggaggaactgggtgaaattatagagcttccaagcttggacggaagttttgagtcggaagaatcgaagaccgaattgaagatcagtgattcagtggacgggtggctgtacccaccgtggtgggcatcagatggcgactttgatgggtatctttttgagcaagatgctgttggaaacagtttaattcttagcaactttgaaatgatgaaataagaaaaatttgtgtgattttttttcccttttttagacatttggattttcatgaacatgtttatgtatatacataatataaataaaaataaaaatatttattagttagtatattattatgtgtactttttatagcatatcgaagaacacaatatgagcagtatatactttgcttatctggtatttcatcgtgagtttcgaatcagatttaaaaatttatcttcaaatatttatttgattataagtttttaattcaagtaatttttattgtgattttaaattttaaaaattacgattttaaattttaaacttcaaattttaacatcaagtgtaccaatagctttgaacagtcttaaactgtttgcttacttcatcaactttaccttcattacgcaaatgaatttttttaaaggacacataaagtaattaagagtaatcaaccttgaaattaattactacaaccatttgtggtgtgccaaataacgttattaaattgttaaagaggatgtaatgccgtgtaaatttaagttatttatactaaaattatacatataacatatatttttcatctaattgaggtaatataattatgtcacgttattccgtaataaagtcttacttgttaaatacattgatatattgttattattgatgttatcgtcctgaaaggcccccctccaaccgaatttgcaatcaaaagtcagaacttgtgttgatgtaaatggtgggtaggggccgggtcggggttgatagaaaattaaaaataacgagtactctagtaaatggtaggtattttctcaatttggaaggttaacatgtcattttcgtatagcgttattatccaatttgtagaaaaaaggtataacactttataaatagagatcgttccttttaacttaatcaacattcacaacgtaattcttagggtttttgagagttttgaatttgggagaaaattttgtgaacctccttgtatttcgagtatatcagttgacgttgttctctctatatattttgtactctcatatttatggtgaattacttgaattttgtgaacctccttgtattccaagtgaattggttgaggttgtgctctctatatattttttactctcatatttatggtgg

SEQ ID NO: 242 - DNA, 4240 bp, Solanum lycopersicum
aacgaacaaaattgatactctttttgaatgttatcataaaagcttgatgtctttgtcgtaagtgaaaatataacgtgtttagaaacttgagatcgtaattgtagatataataataataataataattacttatgtgtgtgtgttagaaattatcaaaatttctattgcaagtggtgtttcagttgtcattttcaaagtattttgaattcctattttctttatttgaattatttagagctgtctacttcttgtatttaattatgtgctgtcattggtaggtttatatttactatatatttacccacttgaatattgcttctctgtatttcatgtcatatttttgtcgggatatactctattcattttataaaaaatggtctaatttgacttgagaaaataaagaaaacttttgtttatgtggttctaaattaaattttatgtcaaatatataaaattgtcttttaatcttatgatcttaagtatgtcaataaaaaaaatattctttttaaaacggactaaaaaagaagatcattttttcgaggatggaataattcacttttcgatggaattactttgttcaactattttagtctaaaggagaaaaatgaatatatggtataagagccgccagaatattgcaataggtaaataggacaaaaatgattttttatattgcaataggtaaataggacaaaaatgattttttctttttcgctatatacaattggattaccttgatatatgatataaccaaaaaaaaaaaaaaaagcttaaaagacatattttaacaagattttagattagttgaaattaatgtcttttaaaatgagtgattaagaaaggaatagattggacaatttatatttttctaagctaatttcgtcattcttaatctgttatataaatttttgattccgttactaaatgacaatgaaatggaaaacaagtcaacaaccccatcactcttatccaatatataatgatttttttttgtttatgaccaccttctatttatatcttttaagtcctacaacatttatgtgaaccatattctctcttgacttatagtaacaaaaaaaaaaatgagcaatgaagtgagtagtgcattgccggagcgaagttcatctccggcaaaggactaccacgagccaccgccagcgccatttattggcgcggcggagctaaagaaatgggccttgtatagggccttaattgcagagtttgtagcaactcttttgttactttacattggacagttaaccataatgggatataagagtgaaagtgatcatgatccatgtggtagtgttgggcttcttggtgttgcttgggtctttggtggcatggttttcattcttgtatattgtactgctggcatttctggtgagttttctcttatttattttgataggggtacttaaataagcgagctggatcaaatttaaacgggttaaaatagatcaaatcaacaagtagtaataacgtgcgctagcttcaatatcttttttcagatttgaaattgaaaaatagtcattattatagaatttcaaatttaacaaataatgtcctgagtttcatcggtatatcattcaaaattttatgataatgtgtatttatgagccaaaattttatgataatgtgtatttaagtccgcttattagcatcatagtatatatatacactctaatgatattacaaatagagaaataatgatttaatgactagaaaaagtggacaatctaataaatagtcgaccatagatccaacaaggataaatatattacatagactccaatttgagtaaacacttcacctagtaggtccaatttgttagttttcttattaatctatactttatgatattttacttttttgggattattgtaggtggtcatattaatccagcagtgacctttgggctattcctttcaaggaaaatatctttaataagaggcttattgtacattgtagttcaatatttgggagccatttgtggtactgctctagttaaggccatttataaatctaagttcgaactctacggtggtggcgttaactcggtcagccccggctatactaggggcgttgcatggtccgcggagatgattggaacatttgttcttgtttacacggttttatcggccactgactctaagaggaatgctagagactcacatgttcctgtaagtataatagttcattttgagtttaacctcaattattatcgtttagttaacctatacatgtttgattgaacaacgtatctcgattaatcttatgtttgtatgttattaaatactgacaagattagaatagaaattttctgattcaaattccgtaatctgtttggtcaaacttctaaaatgtatattatgttattgtaggtgttggcccctctaccaattggatttgctgtgtttttggtccacttggccacaatcccaattactggcacagggatcaaccctgctagaagtcttggagctgctgtcatctacaatcaacaaatagcatgggaggacccttgtaagaatacacccccccccccccttctttgatttagtaataacaacgtaatgtgtgatgtgtgagtcagacttatattttgagctttaaaagttatgtggaatcagaatatgaactttatatgatatcgaattaatgtacaaggaataactaagtttatcgtaaatttgaaatcatatttgaaagtcgcacgtcgaaaataaagtgttactgaataaggtgattctatattcagagttcgaagacaatattctaattaaagacgaatcaatacttaacattctatctagcccttattaattaattgactcttcaatatagatatcagataatttagtcaggtatatagcttaaatatcaaatactttttatacataaatattactatcatattgcaaatatttttttattttttaatatttgatatttttttttacaggggatcttttctggaggacctttcacaggagcacttattgcagcaatctaccaactaatactgaggggatgcaaatggagataagtgatgcaacatatatttgctctagaatatgtgtttgtgatttatgaagtttagtttgaggaaacaatgtttgatttgtgtttgttttgattgcattaatcagttcaaaattgaatcttttgcaaacaattttttttacttttataatacgttcagtattaaatcgatgagttgagctaaatttagataaattaaaatagttgaatcaataaatagatgaactgatatgaaatgaaccaagtcaaaatgagttaaataatgttatttttcttgactttttttttgctcttcatattcctttctttactttagataaagcgataaaagaaataagtgataaaaattgtacatatgtatgtaatatagaaagaaggaaagagaagcacgacatgagataagcggtggagaaatttctatagcaaattacttaacttgatgaacaaaggaagattcctccaaatcaatgttaagtaggtaaaaagcgcataaacaacgagtgtcattatgtggggatgcaattcgttaagctgaggcaaagaatactatctgaccctaccaaattaggaatatgaaggccttttcttcgaaaagaaaccgtgaaaagaaaaagtatagtatcgtccggaccttttctctcgctttgtttgaagtgtcaaatagaaaatggacatataattgattgatccttcaaattttattttaatttgaattatatgtcaatgaagtatcaaatagaaaatggacatataatcaattgatccttcaaattttattttaatttgtattatatgtcaatttctttctaaatgaataatattaaacgaataaaaatatattaaagtaataattaaattgaataaaaaaagaatacgtatcgctataatataatcacaattcacaactatcgtcgtagccaacaaaatttaattcgttcaaattttaatgtaattaggcgagtcatattttccatgtactaattttatcacccaccactacctacattattttaattccaactaccaactaacaaataattattttattttatttttaacaacaaaaataaattcaatacacgacgaatcacactattttttcccaatcctctttgttatcttgttgtttgcatgttccctatttcggttatatcctatcctatccccccgcggcgcattatagcagcaccgccgt

SEQ ID NO: 243 - DNA, 4762 bp, Solanum lycopersicum
aaagagtggaagaatggtgaattgtatatgtatattggttagataattgtatattatacatatgtaattgtatatatggcaagagagattgggagaaggaggagagaggcgacgatactgggagagaaaggagagaggcgagcgagagagggcagagagtaggagagaggtaaaatgtatatgtatataattgtacataactgtatattatacgtatacatttgtataaatgtcaagcgagattgggagagggaggagagaggcgagagagaatgagagagggaggagagaggcgagcgagaatgagagagggaggagagaggcgagtgaaaatgagagagggaggagagagagagagcaagagatgatagagagatgaattgcatatgtatataggttaaaaaattgtatattatacaatatttatttgtatattctggcgaattatacatataatattagttgcaagtgataattatagcaaactatatatatgatgagtaattaaatagtataaatttacttatccgcgtaatttttccaattaaaaagtcctttatgaaaatttgtctaaacaattcttatgtgtttttttaatttattggtcacacataatttattttttgaaaaaaatacataagtaccctcaatctatgcccgaaatcttagaaacatacttataccatactaaagtcttattacctccgaacttattttataaataattttttacttcttttcgacttacgtgatactaacttgaaaaaaaatatcaacagacgttgcgctcagaagatagtgtcacgtaggccgaaatggaataaaaaattatttataaaataagtttagaaagtaataagacctcacgttttttaaattttgagcatgaatttgaaaaacttattcattttcatcaagataaattctttaaaaataaattgatgtttgaccaaacagacttactatatatatataaaacagataaaaggtagaatagtgcagtggggcgtgtggctcacatgtaaggccaagttatctgccactggattgttatcctctccacacaattttgctgacatgaaaacaaattaaagggcacacacctcaccacatccaaaactaaaaatttaaaaaaaggtcatggcatctgctgttgttgctggtgctgcttcttcttcttgctctgtgtcttactcaagaaaccttagcattacaaaatctaattcctcaatcccatctctcaagtcatccaccactccatctcaggtctcatttttaaaatatattttaaattatttatgtagggataaatagcatgtttagtccttcaattatttctaaattctgattttggtttatttgcctaaactttttgatcatttggaatgtgtggttttggtatgttttataatttgcactgtttttgaactatattacccttataatagatgaagtattaatgaacacatacacttgtgaatatatatatacactagaaaaggaatcgaagtgcgtatttcgattaattggaggttaaatcttgcttaatcaaatataataaccaacaggtgtttgtgttatattatgtctcaatacgccctctcctcaaccggagggccacgatttggagttcaaaatatgaataagtaaacaacacgaacaaggagttttatcatttactgttttgaaaccccttaggtttgattccttttcatgggataagcatgtcaaattattttttgattttcaatggtgtgttctttttgtctgttttcattttcatcttatgcaaattattttacttcttcagagaactagttttcaagggctatcattacaagaggcaaaaaggggtgtttcgaatacattcttaggcgcggagagtaagaggaatgctactagcaatggtggaagtagaggcctagaaattactgcaagaaaagctgcagctgcaaagaatatcgaagttgaagttgataagccattgggactcactttaggtccaaagcaaggtggtggagtactcattacggtttgtaatttgttgctctccgttatgtccattcatttccttctgtttaaatgacgccacaagttatggactagtaactagttttaatcagcctgttttggttgaatcatattgtagataagttatagagcttaggtgaacgcgaggggttcaattgaatcccctactccgcgatacaaatgacttatttttggttatgtagaaattgttgaatctccttaacataagaaaatatgctagtgtagtgatgaaggggttcaaaagttgttgatgtttgaggttttttgtgtttgcattttgaatgaatttagggtatagataatggcggtaatgctgcaagggcagggcttaaggttggtgaccaggtagtctacacaagtagcttcttcggtgacgaactgtggccagctgataagcttggatttacgaaaactgctatacaggcgaagcctgactctgtctacttcgtcattagcaggttagcaagtgaagcattttgaatgatcttatgaaatgagacatagctacgtgtgagtactgatgtctttatcaacaaaggttctgagtttaacatacttcgattggttaatattttgatgcagaggtgctgatgtagatgttaaaagattgcccaaacgtcccgctcctcctcaatttggaaggaaattaactgatgctcaaaaggctagtattgatctgtgcatcattagatttgtatttgcttcatgttcatcctttgtatttgtttcttcgcgtaatcatctatagttcattgtcctcaggccagagcaacacacatttgcctcgactgtggttacatatacaccttgcctaagtctttcgatgaacaggcaagtttctgcactcttctatacaagcttataatctcttttttttgggcttcagaaacttgttaagacaatttcggcaagcttttgaagtctctacttctcgtaatttttggcattttaacattgtaagcactagatgaacatatataaaataagtacagtgtagtaagaagaccagcatacctaattgagtcatgtcggatttgacataggattaggttatttccactctgcaactcttcctcaagatgacaacgtcaatgacacaacaaccacactctcttttgtttcaagacaaatggagtgttgatataaagagtagagagggtacctaattgcaaacaaagaaaaaaactaatggccccgtgatatagcctacactcaccaacttactagatccaccaagcacatagcgtccttcctctttttggtatgcagactctactctcagactaacctctagagtgtctttatactcctttatgcccgagtggttatacacttacgtgcatagacaaaataacgttataatttgttgcgtgcagccggaggactatgcatgtccacaatgcatagcaccaaagaagaggtttgcaagatatgatgttaacactggtagagcaattggaggaggattgccaccaattggtgttattattggtctcattgctggtattggtggtgttggagcattactagtttatggtcttcagtaacatctttttatcaaattcaaatttttcctcatgatttattataacttaaagaaagtgttacttaaatgcttgtgcttatataattacacattcttgaaatgaagctcaagtgtgcatgtgcattttttttcacaaagggagagtagaacacacgagttgatgatacgtgtatccaaatatatcaaacgtgtaaagtaaacttattaattttctaaaagatatataatcatgtatttatattcttcataatcgttgtcgtactaggatgaatgatcagaggcgaatacatggttcagacggtaaaattgtcactgataattgatatttctatatgacggttcatttcttatttttattactataacagaaaatattaacaagaaatttaatatatcgatagatttgatattcacgtaagcaacattaatatgaattaatcgggtcagtaaacacagaatatttgaaatgattatagggaaaaaattatgtaatggaagggacaatttttgaatagtaacacgattattatcacttaaaagtggactaatcattttactttagtgaattccatcatgaagttggaagagttacacactattttcatttcttaattttgccccaatttatggcttttcctttctttttcctctatggtaattggcatattaatataatatggtaatataacgcaagactttttatcttatatctaattagagatattaatttgtttcaagattatatattatattatttgaactaaaataatgaaatctattatataaatagtgaaataattaattgatcccatgaaaaattctaatttatgagataactttgtctatcacatatcctatcaaattactcctcggggccattcgattgtatttacaaaataattattgaataagtaaagacggatatagaaaattattgtaaaattcagattttcaagattattaataagattaatttagtaaaataaatattttttgaaagggagtattaaatcaaatttaccaagtgaaaacaaatgaagacttgaaacatattagtatttctttcaatactttttttaatatcattaaataaaatattaattgtcaaatttaaaatttcaaaacataattaataagattaatttagtaaaataaacaatttct

SEQ ID NO: 244 - DNA, 4459 bp, Solanum lycopersicum
taaattttcataaaaaatagttcagatgaacctctcgatcctaacgactccgcccgttatcaaccataaaaaacaactctttatgcactatttcccattgtcttatcatagactaacttcttacctaactaattatgttaatttgactaaaataaattaatttagggggattggtgaaaagtatcatcaattgtgtggaaaaaataacctaaaaacttaaagttagagtaaagtaatccataatcttttataattttcgatgatgatatactctgaatataaattgatatattattaaaagtttatgaacttttacgatatatttttacatcatagtacataatcctctagtagacaaatcttatagtaaagtattgttagttatgaatactctttcatacattcgaatttaaaagttttaagtatgatcgcacggaactgtttatattaggaaacactcaatctctaacgatgaattttttgaaagaatgaaaatttaattagttagccctcaattttgaaacaatcgtgttgtctatagtattttgccatgatttctttactatcttttttcttttacgttttgctttaatatgtttttttcctgagtcaaaggtttatcgaagcaacttatctacctactaaagtaaggtaaggtatgcttatactctacctttctcaaactctaccggtagaattacactacgagtatgtcgttattgttattacttgttagatcttattatgaatatcagatgccgaacgaacatgaaaaaaggtttgtttgtttttttttttccaacaaaactctaattcttctccattatttatggtttaccttattaaattactaattaccaatataaaatatatttttttttcaaataatttctaccattcatttttaccaaaaattccacaatttatcaatctaaagatttgatcaaacaaatcctagccgtccattttccattcttcatctctatataaatcactcaaaaactccatttcattcctctgtgccactcttcttcccaaaaaaaacttcaaaattctctcaatttcttcacttttttcactctactctctctacccatggcgttaatcgtcgagaaaaccacctccggccgcgagtacaaggtcaaggacatgtcccaggccgattttggccgcctcgaaatcgagctagctgaagttgaaatgcctggtttaatggcttgtcgtactgaatttggtccatcacagccattcaaaggtgcaaaaatcaccggaagtctacatatgacgatccaaaccgctgtcttaatcgaaaccctcaccgcattgggtgctgaagttcgatggtgttcctgcaacattttctcaactcaagatcacgcggcagctgctacagcgcgtgacagcgctgcagttttcgcgtggaaaggggaaacattgcaggagtattggtggtgtacggagagagcacttgattggggtccaggtggtggacctgatctgattgttgatgatggtggtgatgctacattgttgattcatgaaggtgttaaagccgaagaggaatacgcgaaaactggtaaatttccagatcctaattctactgataatgttgaatttcagcttgtgcttacgattattaaggacggattgaaaagcgatccattgaaatatacgaagatgaaggagagacttgttggtgtttctgaagaaactactactggtgttaagagattgtatcagatgcaggctaatggaactttgcttttccctgccattaacgttaatgactctgtcaccaagagcaaggtatcttttcgtgctccgattattgcattatttcgttgttgttatctatgccgagggtctattggtagcaacctctctatttgtacgaggtaggtgtaagatctgcgtttagtctgtgtggtggagccatatacacccttttatcggaaatacacattgtgtagctagggtaaaagtatgtattttttttctgtatatgtaatacgtatcgacaccctagactttatgcggttttatattttgacgactcttagttgaaagtctggctccgtcactgagtctacccacccagaccttttgttgctcgaactcttcaaaagttccaaagggtgtgtgtcggattagccaaaagtagtggacttttggagaatccgacacgagtgcgacatcaaaaatgaagagtccgagcaactaaacggtcagacctcacttgtgggattacacttagcatgttgttgttgacttctctttgttgaggttaaatattagatctatagttatcgttgaatttgagtcttgatagttagtgtatcttttaactcatttgatatgtgggagaaatgaatgttatatcattttcttgaggtaaatttaatattcctcttattttatagcttaaagtgaacatttttccaatcatagtattctaataatcttgtgttatagttttgaataatcacatcaagttaattgactgattgtgttggtgtgttctcaagtttgacaacttgtatggatgtcgccactcactgcccgatggactcatgagggctactgatgttatgattgcgggaaaggtggcccttattgccggttatggtgatgttggcaaaggttgtgctgctgcaatgaagcaagcaggtgcgcgtgtgattgtgactgagattgacccaatctgtgctctccaggctactatggaaggtctacaggttcttcctctcgaggatgttgtttccggaattgatatctttgttactacaactggtaacaaggatatcatcatggttgaccacatgaggaagatgaagaacaatgccattgtctgcaatattggtcactttgacaatgaaatcgacatgcttggtcttgagacctaccctggagtgaagagaatcacaatcaagcctcaaaccgacagatgggtttttcccgacactaagagtggcatccttgtcttagctgagggtcgtctcatgaacttgggatgcgctactggacaccctagttttgtcatgtcgtgctctttcactaaccaagtcattgctcagctcgagttgtggaaggagaaggcaagtggcaagtatgagaagaaggtgtacgtcttgccaaagcacctcgatgagaaggttgctgcccttcatctcggacagctcggagtcaagctcactaagctctctaaggatcaagctgattacattagtgtaccagttgagggtccttacaagcctgctcactacaggtactaaggagacagacaaagtgagactgcaaaaagatacacaatcttatagcatgatgttttcttctctttttttttttacactttgatcctgttttcctttggttttggtttatgttttctttgaggttatttaagtaacatttccattcaaattttagcgctagcgtttgattatacattttgaaaggtcatcctcaaatatctgttaggtacttcaactattttcaagtgccctttcgggacttgcactcacaaaacttcaaaaataaatccaaataaaatgcatgtccaagtataacctcaaattttcaagtttcaacttcaaaatttgccaaatcggagctaaaatcttttactttagtaagctagctttcgatgctaagcaagtcgagcattatgctaagatgtggattacaagtgacgagaatggacttcttgtaaatgcaatagaagagtcagagtccagttcccctcccttctcgacgaagggtaacaagataatggaacagaagggggaatttattttatatccacttcctttccccttggctaaaataaaagatgagaagtattctaaattttccttttaccttatcatatactattaatagataccttatgataaaatctagatatcatggatgtgaaaaacattttacattaataaggcatactagtttctttttctactttccaccaacccaaatagagatatgtcagtatagatattaataatttctctactagtaggcatgcatttattctgctaattaatgtagatgaatatagtactactactattataaattttctagataaagtaaaaaaaatgaaattatttcctctgtaaatttaaaatttactgcaacgatatctcgctcaactatttcatcagataactgctacctcccaccaacacatgtaccggtaactctacctgccacggcaacggcttaggggtgcaaggaaatcacctagtacgttttgtctccactgagtttcgagatatagcaactagttggtccactggataaagaaccattattttgtgagacatgacaggaagacaaaaaaaaagaaaaaaaagatgatctacttctgtctgttggtgttagtatggatagtttatgcttcaaatactttgtctctatttagaagttgaactaaacaactccaactagatgggaatat

SEQ ID NO: 245 - DNA, 3003 bp, Solanum lycopersicum
ataatatacatatgtaataatttcaaattaaatttaatcgaactcttgaaatgataactccgatctcgtgtcttttctattgataaaatccatgtactagattcattgtataacttttttaaagttagataataatatcaaacataggcatagtacttttacaagtgtactcttgtccgcaagtggataggttactttatgagatacaaaaatgtataaccattagtaaaatcgatgaaacgttaaattttttacttggttagtaacaacaaatatacagttttaaaaatatgtctcattatgataataacaacctttgtttactctatttgcaagtcttcaaaaagaaattactacagctaatcatagtattattaaagcaaaatgatttaattaaaagaaactactacaaccaaaatatcattatgtagacaccagataacatttggtccaacaggagagttatatgtactttcactataagtatatatacttttttatcaatatcgatcttttcatgttgtttgtttcatattatattatctcaataataatattttgttacatcaatataataagatcaaataaaagtttcacttatcgagtttcagtttgattattaaatggtcatattcacgtggcagcctagtcggcagtcggcaatgaaatggggtccggttcttgagtggacaaaccattatctttttacaaaatcaaagtgatttagtggagtatccaaattgaaaacgaacatatattaattcgaattagagtccctatttaattagtatcaaacctatttataataaaaacatgccttagaacttggaattattcattaaaacaataataatatttgcaaaaattgtccctattaaatttaaatcacgcatcattatctaacataattttctctctactgaagtgaaataatagtatctctggtacacttccattattactagtcaaaaagttgatctacactttttacacctgaacacccttataaaaaatttgtagttactatatataaaccccacctccaagaagacttcaataattcatccaacaagaatacaaagaaaaaaacacatacagaattacccaaaaaaattcaaaaattcatggactattcaaggagattactccgggaagccaccatgtcgccgccaccagcagccagaatcagccacgatacaccacttggtcatagagtcaacacaattgatgcaaatgttattatggttttggctgtacttgtatgtgccttaatttgttcacttgtgttgaactccatcataaaatgtgcatttaagtgctctagcttaatattggctgatccatcatcaaatcatacaagtaacaacaactcttcttccacaaaattagtcaatagagggatcaagaaaaaagcgctcaagacatttccagttataacatatagtactactgaaccaaaacatccggggctcgactctgaatgtgtcatttgcttatcagagtttggagttggagacaaaatcaaagtgctacctaagtgcaaccatgggttccatgttcgatgtattgataaatggctcaattcacactcttcttgccctacttgtaggcactccctcattgacacttgcgaaaaaattgttaatggtggcaattcttctactactaataataatattagagaggcagcagtacaacaagttatagtaaggattgaacctctccaacgtgaaggtgtgatatccaattaatttacaatcaaaatttggtacaaaaaaatagtaatatagctagattttcctttagtaaatctcttctttttccgagctctgattatgaaagaaggaacctagaagaagaatgtatcacacatactcaattaggttagaagcttagagagctagcatgtagtttccaatgagttatcaagtgtatatacaagttaaggtgtatattttccctaaagtttaaagttatggtataagttcctatcttagggtaaattggattttgtattttaaattaaattaagcgggacccgctaatcaatctaactttgaaattggaaaaaaaaatgggaataattgtagatgatgggttgatgattaggaataaagtgctatcaatttattttatttttataaaaggaataaagtagaatggtagatgttgaatattttatttttggatggttaaattttttatgaggttaaaagtgtatatttttatgaataacaagaattgtttttcaaaagataaaaaaggaaccttttccccgaaaggattttaaagaaatataagtacttaaaaacattttttgtattttgaaaatttattaattaaacgcaaaattatttcgtaaaacgcaagtattttttttaaaacatcatttttaaataaataattatgtaaatatggtcaaacagaccatcagacaaattaaagaaatcaaactaggtagttatatagtgaaagttgagaactattattacaatcaaactttattcacggatttttaatataatgaagggaaaattgaatataaagcaaactacctaaattaaatggagggttttatttagctaaaatttgtcagcgtctctctcccaaaaatctcgctcgccactcttgattctcgctcgcctctctcgctttatacacagaagtgtatgaattatgtttctattttgtataaagcgagagaaaattgtaaaaatgtatatcttcgtgttatacacttaattatacaatttacaaacattttacaaaatattgcagagaaaaaggtcaacgaattatacaattgcgaattatacaattgcagtgaaataaattttctctagctttatacaacagttgtatatattgtgtttctgtttttgtataagcgagaaaaacatatatcttcttgctatacacttataaataatgcaatatacatacattttaattcgattcaactgtatgcaaaataaattatacaattgcagcgaaataggccag

SEQ ID NO: 246 - DNA, 4822 bp, Solanum lycopersicum
aaaaaatcacaacttttcaaaacagacacacccttcggaaaagtcacaacccttcacagaattcacaacatttgaaaaaattcacaatccttcgagaaaatcacaattcttcagaaagtcacaatctttcaaaaaagtcacaacttttcagatagtcacaatcattagaaaaagtcacaactcttcagaaaaatttcaaaccttcataaaaatcacaatttttttaaaaaaatcataaccctttttctgaaaaatcataatcgtttgaaaaaaatcgaaactcctaaaaaataacaactcaatcacaaaaattagagctttaatacctttcaaattccaacaaatacatctcaattattacatccataaatatatatacacacatcttcttctttcttttttcaattacctattctcacaatgatagtctaactatcaacctaaattcaacatgatatattattctatgaaatttctaaacgataactgtcacacaagtaacttttatcaccaaagtccattaatattttttggtgtacatcttcaaaactccaaatatgagtaatatctactattgcactaagttaataaaaaaaaattactcttatttataaacatacttcaaaaatcagttatcaatacatatttagaatatacagatctaccctcttctcgattagcttattacgtattcgggcagctgtaatctcttcactaaaacaaattagatcagtctagaactgaaagtggtataattgtaaattcattgaactcaaaggtcaaaggtttaaacaaaacatgatttcttctacctaaagaaaagttgaaaccaaaacgttctcgaattttctgctgacacgtgtcgtgtcccgcggtagtcaaatagccacgattcaaacaaatctttgccacgtcaccacatttagaaacacaagatattttataaataaaataaaatatctgcggatgtctataaatacctgttcagttttccttattttctctgttttcttttctggaaaaaaattttaactctcaagaaagtactggaacataccaaaatcacatataaggaaggaggaggagaaattagtgtattcgtgaagcggaaaacttcaaataattgttgattaaagagattgtcaagttttggaactgtataattgtgaggtgagttcatttcatccttgattttttttattgcagtttgaatatatgttcgattactcgttggagttttttttgagtgtatgtgagaattttgtttgtttgtttgttttttgagtggtttgacggagatgacatcgcttcttagggttttaattggatgatggaattggcattgcgatttcatgttttgtgttgtattaattgaattgatgttttgtgttgtagttattgggttgatttgttatttatcaaatgaaaatgagttatgatctcaaaaaactcacatttgaaattatctgaacgaatttgttataagaggaattgaatcgatttgttagttcatagtgtgaaattagattttcgaatggaagcaattggtttcttagtggcggagaaatgaggattattttttttatctagaaaggttatctatcttctgtatatgaattttttaaaattaagagagcgaattgaatttttaagactgattttgagaaaccaattctgaattggtaagtgatagtgtgaaattagtcttttggaggaaaacaataggatacttggtgatgaagaaaagggagttatttctgtttaggaaggtttactttcttctcgatcttaatttatgtgatagtttcgaccatactcgagggatcttttgagtaatcaacactgaattggtaagagatagtgtggaagaggattatgaactggatttttggatggaagcagcaggttacttggtggcgaagaagaagaatattttttctctattttattaggttacttgtagagaaaggaagtatttttttttaattgaaggctgcggcttgacttgtttgcgaaggctttttgctgctagcttggtttataaatactagtagtagtaacatagttgacattttttctcttcttcttgactgacagaaacagatatatggctgtgcttgatcgaacttcaaatatgatgttacctatggattatacaaggaagaagaaatcaaggagtagaaaagatgcaccaaagaatgtagcggagacacttgcgaagtggaaagaggtgaatgagaaattagacgcgtgtgatgatgatggaaggaagccagtgcgtaaagttcctgctaaaggatcaaagaagggatgtatgaagggtaaaggaggaccggataacgggcggtgcaagtatagaggtgtcaggcaaaggacatggggtaaatgggttgctgagataagggagccacatagagggagaaggctttggttgggtacgtttgatacggcaattgaggctgctcttgcttatgatgaagctgcaagggcgatgtatggtccttgtgcaaggctgaatctcccggactattacgcctcgtcgaaagagtcttccaaggatgattcttcgttgcctactgtatctcgttccgactcaaatacagcatcaagtttctctgaggtgtgccctgctggtgacatgatgagaggaagagccaatgttcctgcggcaagacatgaagatagatcaatagaaattgacggtgctaggactggttctaatgaaattggaacgcctttgagctcattgagagaggaagcggaagacgagaccaaggaggtgtcagataaaagtgagacttttacacctctgagctcgttgagagagcaagcggaagatgaggctaagcaggtgttagataaaagtgagacctttgaaattaaagatgagcctgcggcttgtagttatgattcatgggatatcggacaagaggacctaggtaacttttgtttggatgatgagatgtttgatgtaaatgagctgttaggcatgatggactcgactccagtagatgcctcagctccaagtcaggatgttggttttgttcctcctaagcaagagcagtatgcctatgatccttcatatcaattgcattctgctgcctacgatgccaatcagttgtcaaatccagcataccagttggacaatgccgatgaccagttctcaaatccattatatcagttggataatgcaggtgttgatacattggaaggtctgcagcaaatggagcaacaatcacctatcgaggttgattatgattttgattttctgagaccaggccggcaagaggacttccacttctgcttggatgagttggatgtcttggatttctaatggaattggggaatttggcatggtgaatttggtagacttggtgcattggcaacatggcttggtatatgatcttgtttgctatattgcatactgtatgcaatgaccagaaacttctcaaattgttagttcaagctgttccagaaacttctcaaattgttagttcaagaggtcttttctcagatttcgacgagaaggaaaatacataggatacattaaaacatgttctttgattattttgctcttttggttttgaggaaccacggttccttttgcttttgtactaattacagctgattcttgataagttttttggatgagagaacttagctgttacagttgaatcaaaacaaacataattctgtacatttcttgagatgagttagctaacagttgcaaggttttggtttggttttctgaagttgacaatacaatttcattttatttgcttgtagtttgtcatttactgaaatgaaattcgtagttatgcctgtttggttttttgtattgtgagtcctttatcttccatgctcacaactttctgtatttttctatgttcttccttttcctgttctgatcctgtctctgtgtgtatgtgttgaatacttgatgtagctacaaccagatcctacacgagtgtgtaaagttgtgaccaaattctagtcagtcttactagttgttgtgtcggaactatggtgcttggggaaagagggcataacgaagaaactaattggtatgtatgttgtagtctgaatcttggtttgtatggatattgaatcaaaaagaagcttggttcctccagtattttaggagctggaggtaaccataaacaatatattcggtgtgatatcgtaagtcgagttttctaaggaagaagaaagtacatgtatagttttgttccctaccttacgaaggtatggaaatgactttttattgacttttggttcaaagaaactttatattaagattaggaatattcattgtatggctcatttagcttagatattcttttttaaaaatttaatttttgtctgattttttcagcgttttcttaagatattaaaatacattagtgaattatatatgttaaacacaacatatgaatatttatggttatatattaaccttatattttgatttgcgatcgatgtatttttcgattcaagatctatgtcctgaatgaatcgaagtgtgcttctcagtgcacctctacttcttctcctctttgagcctgattgccgcttttcattaggttatctatgcatcttctccttccatgttttaatcatttttttttttcattttgtccaacacagggttacttttgttctgttttaaatatgtttgtttttttaattttatctcttttgatatatttaatatatatatatgtttttttactttatttatccgagtgtgcatgtgtttgatcgatcggtactactgtattatcatcttagcttacgatgctttgtgcgattgccgaagtaa

SEQ ID NO: 247 - DNA, 3017 bp, Solanum lycopersicum
gtgagttatatgattattaaattttatatataatatatcctatttggtagtttttggaggtagttagcagaaaaatataaaattaacatgatgtttaatttattatttagaaaattaatatgtttatatatatatatatattaagataactaagacataaataattaaactctatataattaatatcgacataaatgatgcatacactttcttataaccaatcttcttattaattactttaacctaagtttaaccaactgcctaaacgacccctgtatgatcaatagtagaagaagtgcatttttattatatcctaaagtgaaaaggatattaatagatagtataatcggtaaaatatttctttttaatttgtaaaagtatgacaaataattatgaattattattataaaaaaaatagataaataattaaaagtatattatttgaagtcaattttcaaatgtctttttttttctaaaaataaaacagaaacaagcaaataactaaaataagtaaagtaagataattaatgcgattgacttatgaaaaaattaaattgaaccaaaaaaagaagagaatgaattctgggcttgactttgcagctggctgagctggcaatcaatttgtttcagacagaatgggcaggaacccacatggcttttcattattttttttaattttttatgtgacaaattttcttccaccccacaaatagtatttataataaaaaatagtacaactctcacttgaggttatcacattagactacactagatattccctacacaatgtgaccaccattaatagaactttcacattaatcgttcgtataaagttaaataaatatatataatgtagcttaggcttatatattaaaaataaaaaaattatgtgtgttcacttatataatttattcatatatattttaaatatttttaaaaacttgaattttcctattttgcccttttctttcccattatgttacggatatatataaacaaataaaatctctcgctttctccatctccatttcttcaatctcctttctctctctatttcttcaatggataataaaccggaaacgtcattagataacccggttcatcaacgatctgaaccgggttccgaaaccggttcctctctatcaacaattacaactcaccacttaacggttccacccggtttaactccggaagaattccaagagctaagctcatctatcgctgagtttcactcctacagaatcaacccgggccaatgctcttccctactcgcgcagcgaatccacgcgcctgtcgaaaccgtctggaccgtcgtccgccggttcgacaagccacaaacgtacaagcacttcattaaaagctgttcggtaggtgaagacttccgtatgaccgtcggatccacccgtgacgtcaccgtcatctccggcttgccggccgctaccagtaccgaacggttagatatattggacgatgaccggcacgtcaccggatttagtatcattggcggagaacaccggttgaggaattaccgttcagttacgacggtgcatggattcgaacgcgacggagagatctggacggttgttttggaatcgtatgttgtagatgtaccggaagggaatacggaggaagatacacgccttttcgctgatacagttgtgaaattgaaccttcagaaattagcttctgttactgaaactttggcgcgtgaagccggtaatggtagtgttaatagtcgtgatgcgagtcacaggtgatacatgtgatttattcaaactataaaaagaaaattgtcctcttttctttttattttttatttttacttcttactcgttctttctattgttttggggtttatgtgtttgacaatggattaatagaaaaaagataaattaaattttcaccgttaaatttttttttagcattatactatgagttatgaaattgttgatagtcaattgagtagagtacgtttttatgtggcatatatgttaagtttgtgcttttgattggatcatttctccagttatttttttttccacatatagtaactatttgtccatttccattcaccaattatttgctcctaacgtgtgtttgaagtaactttctttgctttattattatgtcaaccaatcactttgttaatattgatactccattaatcatacatgaattattgtatctgacatcaacctacctaattcagtttattgacggagtctaaattttcaaaaatattttggagtgaatccacttgcgtttccctagggcccactactgatttggtggatatgtgttaggttgatgagttttaaaattaagcgttaatggataattatgatatttaacttggaatgtatttaagtagaatttaaatttatataaaattaaataaaaaaatgtatgatactttacgtgatgtcttatttatattatgtcatgtaaaatatgtttgtctattatataagtttaatgtgtttagttgtgcacatttaaaattggagagtatagttgttcaccgtagccaagctaagagtcatgtaaaaattttttaagtataattaagatttaatatatgggggcatatttatattttgaaaggtatataattgatgactcgatgctatggagtttttgtaattcttttggtatatatggatatttctaaggacttttttgcacatatattcctgctaaagtttttttcaagaatattttctgaaaagtttttcttaaagttatctatttgaagagcaatttgcgttttgctgactgttttggaataaaagaagttcttagaaaattattattgtactttgtttggattccaaataaaggttaaaagtagttgcttaaatatactagtgaataattttaggtctttaaatttgttaaaattgaatcgtttcaagttctatcaaatattctaatattctattaattacatttgaaagaaactatattaaaaagaaattaaccagaaataatagaaacgttctatctatcttaaaaat

SEQ ID NO: 248 - DNA, 3591 bp, Solanum lycopersicum
ctgacaaacaatgtcaaaggaaatgtttaaggatctattataagttaaactaatgattgtatattgtaaatttaaaaatatcgaaaatatttttaacaagtcaatttacgatgagttttattaaaatattatttttttttcgtaattacatatcgagctctccatataggaaattgaagttggcttatttcattgttattaaacactatgaatttcttatacgtttctattagaattttattagaaatatgaaatttaaaaaaaaataaaatcattgaatacaattccaataaaccaattttagtcaaattcctttgaaaaattctacctttttttttaaagtgatagaacaagtgttctatagaggcaagtgaagttgacgagctccaatacaatcatgattatacataacaatataatggagattaaataaaattatttttcctttcgctttaatttgtttgtgttaattttcattttcagtctgtttgagaaacactacacaaaaaataacttttatcagcattaaatattgatattaataaagaatgttaaagtctttacaggcattaattaagtgtcattagaactgatgtcgctaaatgttttagggacttatataaagagtgctaaattaccgctaaaaatacatatttagcgtcaatgaggaattaattgccgctaatgatcattttttatgtagtgaaaaaatgttcctttccttttctgtcaactctctgcatgtttaataatacaaaatgttttagttgattatatatatctttaccttaagattctaaaatttgcgaactttgtatacttaaaactctgtatcaaattaaaacgactgaagtaatatagattcatgtacatgcaagatcacatatagagttgccaactagcaaatattggccatatagcccctcatgttcacgtgcattggttttagggttttttttgttttcattcaacaatcatcaagtactcaaatttttctatctatataacaccacaatctttgtaccaaattatttaaccacaaaaatggagttctctaagataacttcacttcttttcatttctatgcttttcctttcttcattcactcccattcttggttgtggctattgtggtaaaccttctcacaagcccaaaaagcccaaagttccctctcccattgtcaaaccccctgtcgatttgcctcctatcggaattccaccaatcgtgaaaccacctgtcaatttgccccctattggaattccaccaatcgtgaaaccacctgtcaatttgccccctgtcggaattccaccaatcgtaaaaccgcctgtcaatttgccccctgtcggaattccaccgatcgtaaaaccacctgtcaaattgccacctatcggaattccaccagtcgtaaaaccacccgttgatttgccacctgttgggattccaccagtcacagttccaccaatcgtaaaacctccagtcgatttgccacctgttggaattccacctgtcacagttccaccagtacttaaaccatcacctaaagggaaaaaaccttgtccaccaacaacaaaggcaacatgcccaattgacacattgaaacttggggcttgtgtggatcttttaggtgggcttgttcatattgggcttggtgacccagctgttaatgaatgttgtccaatacttagtgggcttgttgaacttgaagctgctgcttgcctttgcacaacacttaaagtcaaattacttaaccttaaaatctatgtacctctagcacttcaactccttgttacttgtggaaagagtccaccacctggctacacttgttccatctaggtaattggaacttttttccctattttttcgctcggtatctggtactcgctttgctacccaaccaatgatcgataaagcctcaaaaaaaacgaagggtgcttagttattaaacacccttcgtactactgtttaaacatgcttagtgaaatttatgattttcaccatctgacctgactaatttaaattagaggtgaggtaacgcgacttcatttttaagtgtcgaatatgaagtctatagttacttaggtccccatctttattggttattaagtaaatttatatatagatattaattaatatcctgataaaaatgatatatataattaattacttgttattacatattaacaaatatagataatatagaaatatattaaccctaactttaccttgaattttaaatataaacttgcattgttattcaaaaaagaataagatacgaaatttgttgttaatctatcgctaaatgaaacatatctaatataatttattttttttaataattcgttagtaactaggattagctacgtatttttattgttaattaaacttattattaatttaaattctgattaaattgcaggttttcattctgaaatttgaagaaattgcatggcttgacatgaaaggatgtccaatttatgatttatttaatttctctccaccccacccccctcaaaattgtattttatgtattgttttattttggctttgtggaattgttatttaatggaattattattattattatattatcattattactattattattatttcagtgtatcgtttgaatgtcatttgtttcaatgaattggaaaaaaaaaacaagtatttgccaagattaatttttttatttattttaataaaagaattaactttacattaagttaaggtgtcgagaagttatgatattaaggatagaatatgaatatgccaagatcaatttttttttttaaaaaggtgtcaatattcttttggaataaattaaaagaaaaacatatcacataaaatgtgatattaatgatttgaaaattgtaactttgttatatcaaaattggatatttttttttaaaaaaataaataaattggaccatgacattttgaagatattattgacagaaccaaacaatatagtccatataatatttccaggtactcaaataaggaatcactaagtaaaactgtagaaaccttaagtatcgaatatttatattgaagtctgatgaaattcatatttacggtacgaaatttgatgttagtataaagttctcatagcaaaagcaattttatgctcgaaactcaaatctatgatcatttaattaataatgaaaaagtgtttatcattctacttttaatcgttattagtttgatgagcacttctagtttccatatcatgttacttcatattgcaaatgacaagaatgttaacttttgtcttgtttaaatccttagagttcaacttttgtagacattataaaagaaaatttactaaaattattgatacgatactagtatcaatggttgattccaagcctcgaacctcaatggcccaagcacaaaactaaaatgaccctagatgggaaaatattaacagcatgttatcatatggcaaaagtaaaaattcctatggtgaacccagaagtgttttgaattgagacatagttatcgtaaaaaacgtaacataaaaaatgcagctaaaataacaattttataccaagagaatcaactctataatgcaagaacataagataggca

SEQ ID NO: 249 - DNA, 4143 bp, Solanum lycopersicum
caatttctaagtagtcaaccactatcctatgtgaatttcgaaatatacacttttaatcttttttcaagatatatttgtcgtttgtcaaactcgtatcgatcaatactccattcatctcaatattattacctatggattgaaatttcctcattaattagctagacactgaatatatttctttctcaaccatttttcaaaattagagatggaaaaagagagagaaaagaatgagagtttctcgtctttaagaataaagaatatgaaaaattattgatttgaattaatcgaatcagtatattttaaatattatataattaaacaaaaaaacaaaggctagcaaattttttcctcccaaatttcctatttatatagtttattattacatgataaataattgcctgagtattattttcattttctaagtagtcaaacactatcatatttcgaaaatattttgactcaatatgaaaaattatttgacctattaatattctcttacatataacccaaaaaaaaagttattgtcccaattaaatctttgataaatcaacaacatggataccactacctttgcagttccaatatggataaaatcattatccacaaaggtactaatatttatttcacgagaaattacatgaaaattactataaataaataaaaatatataatataattaaataacatattttaattataatgtaatgtattcatgaaaataatctcaatatttttattgattattatattaaaatatcatcaacaaaaataataaacaaatgctatgattatattctttaaaaattatatatactaacaacgtaaaattgaatagccggttggtgataacaaaaatctagatttaaagatttttaaaatttagaataagttattataggaatataatttaattgttgcaagtcaatcattaggttgccttggtcttccccgatcctatgcttcggttacgaaccttctaggcttggtattcttgctataaatagtaggccttttcccgattggagataagacttcatacgtgtacgagtcgctcctgtagttgaaagatatttttctcttcgtttaaggtactgtaaatatcactattatggctattagtttcgaattttctggtttttgatttgcgatttagtctttccgtctaccgatctgttgaattgtgtttgaaatttggatttttttaatgtaatttttgcttataatgattgatttttggttgtgatgaactttttttctagcgatcgtgaagaacatttgatgagtatgaagtttgaattggaagtgagaagttttactggaaaatgattgatttttggttgtttgtattgattggtgagcatcttttagctgaactgtaattgatcagttggaagatggaattgaaattttaatattacatttccgctttttgatttgagattttgtcttttgtttttccgatctgttgaattgtgtttgaaatttggattttttttgatgtaattattgctaaaaatgattgatatttggttgggatgagttgtgatgaacagtttttctagcgatcgtgaaggatattttgatgagtatgaagtttgacttggaagtgagaagtttctaatggaaaaatgattgatccaaatatattttccaagtcaaggtcaatcaataactgaaaaatgtttgacttgaaaagtttgatcagttggaaaactgtgactatagattgtagttttaattatacttttcattgattgattgaccttgacttggtctgtggcgatttatagtcgtttatctaaattccaaaaggtctttttgatgattatgtgaaatttgtatgagtagatctgttggatttgagtagttttcgtggttggaattcattattttagttaaatctgaaagagtgatggagaaagaatagttgttatagtaagttgatattgatgtggaagctgagtattcacgtttgatagattttattcgttaattagagaatatttgtttgtaatcggttccatggttttggttatcatcgtagaatcattcctcaaggggggtttgttaaagtagttttgctgaaatttctagttttctatgttctagatattagttgaatgtttgagttgcagcttcctagattatgtgatcatatcttgactctttgctgtatttatgcactaatatgttggattcattcttttctcaaatgtcttcagatagcaatttggagaaagaagaatggcgttagtttctggaggaaggtcgtcaacactgaatccgaatgcacctctcttcatcccatcttatgtgcaacaagtggaggacttttcacctgaatggtggaatttggtaacaactgcaacatggttccgcgactactggactagccagcatcaaggagaggaatatggtgatgatgattttggttttgctggaaatgatgttgctgacttgcttcccgaaaacattgatcttgatgtcgatgaggatattttgaatatggaagctcagtttgaagaatttcttcaatcatctgaaactgagcaacaaggcatcaagtcatcactctctggtgtcaatggtatgttgcaatttagtatacaccaatctccattatctacgattccgtagactatgattttcatgtcgttggttcttactcgcatttacctcttgactacaggtttacccaagggttctgaggcactcgtaaggacactgagcatgccaaagccaaaatctcctatcgaacctccaaagttgtacgagaaaccagcaaagattgttagcccaaagaacagccttcgccgcatccagcagccccgctaaatgtagttcagcttaagcagaagttcttggtttgtagtttgggtgtatgttagttcttgatctgcagcttttaatctttcaaaagcagcaattgagaaagtttcaagagtctttagttcttgtttatcttttgcatagagcaaggtagacgtggcacttttgtatctagccttgttcatagttttagtatatccttttcatcagttttttaactttgtaaacatcaaaacttgtctaaagtgaaaaaaaatatatatgtaaaaatcagttgacaaaaagagcatgtcttttgagttttatttcttgaagaatgttctaaatttctgccttccctctttagtttcagcctttggggatgcaggccattataatttttggcaattccttcggtcttggatggtctatcggaaacaacctctataacttcaaaggtaggtataaggtcttgagtatacgctcacttgtgaaattaggctgttacgttattgtttatatattttagcgttgttttgaattcaaatcctgaagctattagtctcaatcaagtgttgttaattgataggtacgctctatcaatcctttcttagccttgtgtctaggtcacttttattaatggttaagtaagctctctatcaataatctctttaggtcacgattcaaatttcagtattctatttgtctgaacattagtaggtcatctttactcaatatttatattaattaaaagataattagattaggtacaaatttatctccaaaaatcagtgtcattagataatgtagcttaccaaaataacatgattatttctttgaaaaaagataagcttaatgaaaggtccattaggctaaaaagattttcctcatcattgggcactagctaggaagagtccaaactccactttatttcttttgtttggtttgggtctatgttcatagtattaattaataattaatgaaagcaatactatgtgaaagtgatcccacattgtctctaatttcattaacaataacatttaactcgtagaacccaacaagtaacaagtggacaacactatgattttcatttgctttaatataggtataattacatgttttattttttatttatttcattaggacagacatcttcattaatatattcttcttggtatatgacttttgaaatattttacttaaattaaatttttattaaaaatatattttatgttttcacaaaataagaataaaatctgtattaatagatccataggattgatcaagtgaataggacttttgaggtcacaattctgcaatttgagattattagtt

SEQ ID NO: 250 - DNA, 4776 bp, Solanum lycopersicum
aagtatttttaagttaaaataaattttaagtcgttttgaagtgttttggtaaagtttaaaaaatgcttataaacatttattttaaagtcaaaataataaaaataagttaaaagtcataagttaaaaatcttaagtatgactttggctttataagtcataagtcaaaaatcaattcaaacatactctaattttaggtgtttttaagtcaacataacttttaaccaattttgaagtatttgagtaaagttaaaaaatacttataaacacttattttaacgttaaaataacaaaataagccaaatataaattaaaaatcctaattaataatttttaacttataaatcataagcaaaaagtcaatttaaaaccgaccctcaaacggcagcaccttctgagaaacatcataacaacttcttcttttttctataaataaaaaagtgaagtcatttagttatcaaaacaaagtgaagtgagttaacttgtgctctcctctgtcaatattaattattcatcttatgataaataattctcataaattatctagtaatttactaatcaaaagtcaaaacaatgaatttcttctaccattaatattttttaaaacctaaacaagtttattcaaaagttttctctttcaaatctgtggttaaaaagtaaattaatttactaaaactattcattttatttctaattttaaaataatgaaaattgtagaaaatccaaagagagaaaacggagttactcaaacggcgtacgcaaacctccccgtaactgccacgtccgtgaaatgacaaaagtgtgccccactttgtttcccattatgttcttatcatcagaagcaactaacaattagtaattaattaatttaattaagtaattaacaaataagtacatttatttatacttctaattatcctatacatacagaccccttatatgtataggcgcgtcttgttaaagctgtgtatatatatatagaaccaaaagcattcatctaattcatcatccaatctactctattattcaaaacctctgttttcaccttttatttttgcttctaaaatacaaaggattcttagctttctccttataaagactcaatcttttgcttatgtattagttcagaaacgttcttgatacaaatttactatttgggtatgtttcttttttttcattatgtttaagttttattcatgtcagtgtagataaaggtagccccttttctgtttttgagaagattttgatgatagagtttggatttttattgttgagaatggattggaaagttcagatctctatgttttgatgtagtctgttcttgaagtatcttgtttctgcatttttgttagtggggtttgtagtttttcttatctttgttgtttgtgtggtggtggggttgggggttgattgttgtgtatggtctttcttatatggacttgagcaatgctgtgattgtgctagtttttgtgattgagttaggcttaggtgtcgtatctttacggattccgtcgtactttgttgggattggtaaattcttgaagatattagtagaagttatagagaatgataagattggttatgtaggactaatgaagattatagtttctatcatcaacctgtaaaagtggctggttttggatatagtttaactctcttttgaagttgtagggacaaaaggtttttcctttctggtttgggtagcaaggactaaaaaagtcaccagaatactgtttctatcatgatcctgaatatctttcttcaagtctgcagctcaggggttttttcttgaaaattacctaaaacatatgcttttgactattcaacagtgtcgccgcatccgtttcagatccttaaaagtaaattacttttggaggatccgacaaatcatagaactagtctctcttatacttcttgttaagttatgatcctcaattgatccaatttttgggatcttacataggaggcagggcacttactattgaaatttttgaaggagagattgaaaaatcggataggccttacaattgagattttgaaggagagacgaaaatcaattacgagaacttgattgttataatgaaatgtggttataaagaggtctaactgtagttttcatttccgatagcatcgatcaggttaaccttattttgggtatctgtggacaacaaaagatatattttttatgactcaattctgtggttttccatagttaatgctgtaccactttgctctcatgacttattggtgtacttactttgataatgaagccttatcttaaggtggtttacctattaaatatgaattgacttgtgagttggataggatgatcagagacacatatttttattaaatgccttaggtttatccatttatttactatctaggcatcaatttcatatagttgttcttatccttggagaaactgatttgtacttgtataatgttagacttttgtgatagctgttggatattggcttttgggaaaaaccaataggtagtttctctttgtactcaacttgtgcctacatttcattgaccttgttgtttttcttcatctaagactagatccaaataatggggcattctcttgtaattgattagtacgtttagtattgcatggcgtcttttgttttatcgttgcccctttgagtgtagtgtaccatgaggagaagatcaataacatttccttaaggttcacatgttcaatgtttatcgtagttctgtatagtgtttatgaatttcgagtctttgttcttttggttctgagatccttgaatttgtatttttacaggcattagaagctaactttgttacatcaacaagcaggatatggccttagaacagctggacactacctttaacaaacacgatactccattagggaaatggaagacgatgaacgatgaagttgaagagaatatttccagtggttttgaatgtaacatatgcttggatctcgtccacgaccctgtggtaactttatgtggtcacctctactgttggccttgcatctacaaatggattcatttccagagtgttccctcagaaaatttggatcagcagcaaccacagtgccctgtatgcaaggctgaagtttcacaaaaaactttgattccactctatggacgcggtggccaatctaccaaaccatccgaaggaaaggctccgaatcttggtatagtgatcccacaaagacctcctagtccaagatgcggcggtcacttgctgataccaactaccgattcaagtccatcccatctacttcaacgacgaaatcatcaacaacagtctcaaacacgtcaatcgccttatcaacaaagcgcctcaccaggcaccacagttgatatgttacaaccctccatgattggacaagtggcctatgcaagaatctttggtaactcatcaacaactctgtatgcatacccaaactcttacaatctagccatcagcagtagtccaagaatgagaaggcaattatcacaggctgatagatcacttgggagaatatgttttttcctattttgttgctttgtgacatgtctaatcttgttttgaacactttgtctgttgcttctactttgtaaaaaagaagatatgatgttgtagtagataagaaaatgtacagcctcagctaaatgtgtactaaaaatcatagaagcatttgctttctttgattgttgataaaacacacttggaatttgagtgcttgaagactgaacccttttttgatgtattaatctaagaaatgaggttggaaactctatccattattgtgcatagagatgagttttactactaattcttgcgtaattaatttctacgacattaatcttttgtaccaaacaacccattagtgtgtttggcgggacgacaacattttccaaaaatatatatttcaattttcattgtttgagaaatattatctttaaagcaagacttttagcttaatatagcgatacaacgatgccaatttgattaaaatctgttgaatgcgttgttccaccagctccagaaaaatagcaatgctatataaaaataaaaaaacaaccctatctatttaaacatcattttcttccaaataatatagcatgataagttatgaaatgatacataacaacattaataacactaatgaaacttgtttttcctttttataagcgaaattattttcttgatttttatctgttttacttttaatatcccggacttaccacctcatcctgttgtattaatttacattatgtataaatgttagtgtacaatattttacttaactttccaaacactcgaaataaataaaaaaagattatgtttttttttataatcctaccaaacacaccctaaaaggaggctaattttgtgtaccttatttcttatcaagaaacaagataaccaaaattgaattggtatattttctttgtcaacttattagttggtggaccttatttaattcttttttttttaaaaaaagaccaattctgattggttcttttcttattctttctttagaatataatattgttattattattttattagaataaaaatggtgtgtcaagttagtccacatagcaaagttactagctttcacattgtaatggacattttaatattattttcatgataacgatgttgagatagttcgtatatctttcgattaatatgaaataattagtgttttctattaatatatgtatattgaaaaactctactcaatgatattagataaaaaaagaagtaataattaaatgttttttttatctattgaaatttaaa

SEQ ID NO: 251 - DNA, 6514 bp, Solanum lycopersicum
gtgatataatgtgatggtgttgagagtcggggtcggatgtttgggaaaagataataaacttagggctcgtttgaccatgcgatatggaatcctgatatgatatcataatatggactcatgagatgaaattgaagatttgtttggatatgcaatataaaatttttgttttatatattttctcataaacataggaatttcataagttataaaactattaaaataaccacaattgtttattcaatctaactaaataaataaaaatttataaatcgcataataaattattacaaacctatttgttccctacttaagtaattgttcttcaaactttaacttattaaaaaaaattgaacataaattgtagtaaactaatctttagtataatcctcccacataatatggaaaatctcctcacgtttaacttgtatttatcaatcatgtgaccgagaagacgaaccaatattgttactttgacacatttgttggtcaatgtcatccgcaactatattttcacgttcatagaccataaatattttatcactccttgcaaataattatgtaacactacataagcaatggaagttttcacttgtgtgacaatatcataatggttaatggcttgttgcagtattttgaatctatttttcaagctataaaaattcgtgagattgttttaacaaaatataaaaccgtatatcactttttgtgtttaaaaaaaatatcaaatcatgataaggaattcccatataataacatatcatgatttttggagaatatgatcagattgaaattgcatatccaaaaactgatttcacttcacgatttcatatcgtcatatggtatcacgtgaccaaacacctactttgaataatacttacgaaattcgtttttcttttcatagaaaaatattttaagctaacatacatgaaaaaaataaaataaaaaaataaaaatttgttttcctcatttccaaacacaccattattattattattattactaataattgaagttagagagtcgtatatagaattggatctatttgtagactcatcctcaaaaacactatttttattttctttgattctgtggtctgtaaatcatggctacacaaggtcaagtcatcacctgcaaaggtacctttgttttttctctctctatattctatgcatcttcatcttactatatatgtgtgtcacttgcaagttttttgctttctataaaccctaaatgttgtagcttaatgtatgattatggattgtgaaaatggtgtatagctgcggtggcctgggaacccaacaagcctttggtgattgaggatgtgcaggtggctccaccgcaagccggtgaagtccgggttaaagttttgtatactgctctctgccacaccgatgcttatacctggagtggcaaggtaatctaatccatacatctttctccgttttattagtaattgcaagattttggtatgagttaaatttgatgaaaatctaagtgatttgggattgatgaatagttgaaatttagagaatggagttgaagctttttgcatttcggcaacaatgttaatttgttttggatggctaatgttgtgacattttataacatttgacctatggaatttcattgaaacatgcatacccagatttaagcttcttcacaccatttatgctcaagggcatttgcagaatggcaagaattttttgttctttcattcttttatgaaaaatttcttgcatttcatttgtggttttctggaaattggagaaagataagtctggagtcaatggtttaagatcattagcttattgaactatttgttgttgtttggtattgctactaacaatctaacacatgtttcttttttcttgaaggatcctgagggtctcttcccatgtgttcttggtcatgaggctgcggggtacgtgctgtctttgtgtcatagtgttttgattgaatgtactagcttcgattgaagctaaacaagattttttctggatgccatttttcttggtcttaggctcttagctatctaaaatttgcaggatagtagaaagtgttggtgagggagtgactgaggttcagccaggagaccatgttataccttgctaccaggcagaatgcagagaatgcaagttctgcaaatcagggaagaccaatctttgtggtaaagtaagggctgctactggagtgggagttatgatgaacgaccgtaagagtcgattttctatcaatggaaaaccgatctatcatttcatgggaacttcaaccttcagtcagtacactgttgtccatgatgttagtgttgcaaagattgacccagtagctcctctggagaaagtctgccttcttggatgtggtgttccaactggtaaattgactttcagacctgatatgtgattgaactaatatcttgtgattttcttcaggctaattcatgaaacgtattctgtagcatctcttatttagtgctgtccattaactccttttctaatccattatttatcaataatagaggtgtaataaactgtggtgttggttctcgaagtatttgctttcaattttcatgtgacttcatcatctttctattagttgttctttttgatttgttaatctctcaaattttggtcaaaattactgcaacacctgacacctgtcaaaattgagagcacttctgagataatatgatgtatgtaaagggaagacaggattttgagagaatataccccaagataaaagctaaaagagagaagtaaaaaaggaaatttaaaaccaagttatcgtataaatgattgattgcgcaaggatggaaatatatttgagtatattgtttagggagcatgtcatcatagtaatttgatctttatgagttagtagatagtgtcttttggttggtttatccaggtgtccatcttatttatcattttcatcacttcatgctggtttattcccttagattagaagttgaggaagaaataaaacatagaatgcccatctaactatatccctttgttccttccaaatccaatacactgtgttttctttagttttagataatgctaattacattcttactctacactccttgcgttttacattgtgtatttgctgtctttaggccttggagctgtttggaacactgcaaaagttgaaccaggttccattgttgccgtctttggcctgggaacagttggtcttgctgtaagtatctaacaatttgattgtgtgtcaaataattaagctcctttaatatatttatgcaatctatttatttgtttgttaggtggcggagggtgcaaaagctgctggtgcttcacgaatcattggaattgatattgacagcaaaaagtttgatagaggtacagctttgtccaatttgtctaggattgtgaactatgaatttttaggaatagtaagtatatgattaggttccaagtatattttgcatcagatttgtcagaacttgctactcctaagtcctaagatcaatttcttggtagacttcaaatactagttactaatgtctaatgttcaatcaaaagctaaagcccctagggctttggttcaatggtaagagtgtgtctcgtgatgtgtgattaggtgcacgtcatgaatttgtaccctgttgcaaacaaaagccttgtatttaattggggaagggtagaaggatgggcccattaccaccgagtttcaaatcatgggccagttggtcctcagggatttctagattattaagtaaatgtttgttaaaagcagataagttagatgtatatctctaggggctcttgtagatatacgttttgcatgtgcttagatggttttttctacatcatcgctatgtcatagtagtagattgtgtagagaacttccttatggaatggagtatgtaatggtaatggaaaagaaaaagaagcctaataataatttgttgtcttcatgccctcatcctttctaccaaatcaaatgcaacagccatttctccaactaagaatgagacagagatctctactaaaaatgatgctgaacattgccttgccctttaggtcttaaaactttggtttcaatcagtcaacgcctataggtgcattttcccctcttcagttttctgtcgatttctcaagctcaagctgttatttcctaacctctctccagctaattccatatcatttcaagctttaaaattttgaaagcaagagatgatatttttcgccgaatcattttaaaactttcagattagatgtcatgatttaatcagtcatatatcttgattatcatctgtatatttctgtatgataagcagtagattgctcttataaaagtctaatgtataaatatcttgtttgatctcatgctgattataggaggaaacaagttgttaaacaaaataattttgaagcttatgtcagattgaagtggcggtgaaagtatgtctggttaagtttaatcagacttattcaagaaatagcatttgaatcaaacttgagcagcacaacagttttcatgctctagtgtccttaattattctgttgtatggcacataagttgtcacatcatctgatccatatatttaactgttatgcagccaaaaattttggtgtgactgaattcattaatcccaaggagcatgagcaacccattcagcaagtcattgtggatcttacagatggtggtgttgattacagttttgagtgcataggaaatgtctctgttatgaggtctgctttagagtgttgtcacaaggtaaattatgctagtgtctaatcaataaaattgtaatttcagtttccccaccacgtcttcactccgcttgaaattgctgagcttccccatcccacgttcccctttatctttcaatatttttattttcatttcccttccggatgctattaatgtctccaccttatgaaaaaattaatctattgtacaagatactaatgctgaacatgtccaatcttattggaattgcagggttggggaacctcagtgattgtaggtgttgctgcttctggtcaggagatatctacacgtccatttcagctggtgactggtcgtgtttggaagggaactgcttttggtggtttcaaaagccgatcacaagttccttccctcgtggacaagtatttaaagaaggtctgttatttcccttttcgatattttcttcttcccttatttaccatttagtcactattcatttatccaactcttccactactaataggaaatcaaggtggatgaatacatcactcataacttgacacttgcggacataaacaaagctttcgacctgatgcatgacggggactgcctccgtgttgtcctggatatgtttgtatgaatgaagtctgtaggctctttatgttgcttactttatgtttttgtgctatatctcagacactatttaccttttcccttcctaattatgtgttgaataaaaagaaagagagaaaaaaaggatcaagaggacagatgaactctttttaaatggatggtagtttattatcttttcaagtaaaatgttctactttgaaggctaaaatcatcattactggttttagagtttggcataaaccattgccatgtttgcataaatggaatcctcccttttccaaagtagccaattggtgatatatatatctgttgaaatattgagaaaataaagctcaaaatagtcacttctttgggtctaaattcaaagtattcctctatgattacagtattggtgcagctttcatccctttttttaacctcgccatggatttcacacatgcaacagtttaaatttatttcctagcaatatcatttctctacaatacattaacatacaatgaaatcttaccaaataaatacagttgggatgataaatattattattttatagaaatattattatattgataatttaatgtttattaatttaaagagtgtgttgatactgcaaaatttgttgagggatgaaatcttatagaatctaaatgaacccactcgtgaaaacgtcattcatggatttgaggtcatgattaataatttctgttacctcaataaaatgaatgttaataacgtgttaaatgagtgaaaaatgatacaaatgttcaaaggttcagagtttagaagaaattgtggatataattcaaaaaaataatgttaatgataaagttaaagatgatacggtatttttgaaatcagttacgcgtaagaaaacacttatcgcatttaaaactcttcaggtgtcacgatccaaaacgggtcgtgaatggcacccacacttacctccttaggtgggcgaaccaacacatctaaacctcaacatataccaatagttcaactataaataatataaataatgcggaagctccaaaagatactaagcaaccaatttaaataattttctaaagtttaatacttatcatcccaaaatctgatagtcatcacatcaaggacatctaacctccaatactaagtctaagaatatcgaatacactaaaataaagaataaaatggtatgtgtccgaaagta

SEQ ID NO: 252 - DNA, 3710 bp, Solanum lycopersicum
aattaattctacttaattcattttttaattattaatatcatataactgtccaaaaattattgctcatatgatgcctcacaaatcatgctttgtctttttccaagtgtaaaaagggaggtgcaataatgcattttggtttgtatacattttgtagtttcaaagtcttatcatattagaatcatagaattaatgagtagtatgatttaattatctaaggcttgtttggtagttagttagaaactaaatcattcaattgtattataaatgatatgattagcattagagaggataaaattatccaataaaattacattttatttaagtttaaattaattatttatctgtttatttattaatttaatttaattcaattcgattgattttacaaatagccttaaaaagattgatttagaatttcgaatctcgtttaacaaactcattaaataaattgcttcatctttaaaaaaattgttaaacataagtatgaattgatttttctacttataaagcagatgttcagaatatttcaagataataaacttattcaattaattataagttacgtaaaaaataaaatctaacgataataaattaaataatattttatttgaacatcggaatttatggtcgcgagcgaagctagtaagcatctcggaattctttctaaacctctttcaaaattaaaatatatagtctcttcgatttcttcatatatgtacctcatgtttcgaatgaattttaatgaaaattttaattctgtccttcgaactgactactctagagactatctccaggtccaaacaaacccacgaaaaacagattcaacgaaaattctgattccgtccctaaaccttactaccctagaaactacaacccccccccccccccccaacaaggcccaaacaaaccccaccgaaaacacaaagcaagagatgattaacacgcaattgaatccatccatttactatataaaaaaacatacacacacacactatactccatacaaagaaaatccacatttagttttaaattttcccaaaaatttcaaaaatgaaaattttgattttcctaataatgtttcttgctatgttgctagtaacaagtgggaataataatctagtagagacaacatgcaagaacacaccaaattataatttgtgtgtgaaaactttgtctttagacaaaagaagtgaaaaagcaggagatattacaacattagcattaattatggttgatgctattaaatctaaagctaatcaagctgctaatactatttcaaaacttaggcattctaatcctcctcaagcttggaaagatcctttgaagaattgtgccttttcgtataaggtaatgtttattcgttcgtcgtttcaatttgtttgtcctaacaaaactcgactatgatgaattaggattttatgtttattttttctgtctcaatttgcttgtcttacttctttttttggctaaaagtttcgaccctatcttactggttgcttagtgaaaatttcaattatggtgaataacgagctatttaattttttttctagttcaatttatttatcgtatctttttaagtaaaaatatcaactctaaataaggagttatgtttatcttacttctttagtgaaaattttgcttaaactaaatatctaattaaaaagaactttaatttttttaatatatattaaatattgatgtcggattaaattgaacaaatcgtagaaaatgatattctttttgttttttaaactcttgccataatttggcttaatatagacttttagaaaaataaacttttgaaactttgatgttaaacatgttttttcctttacgtaacacacttctcttacttttatgtgttgtccattctaatttaattttcttttttttagtaatagaataatttataatcacataactttccaaacttcatttaaattacaaatcataaaaaatgtttctttataaaactttgaatttggacctagtttaataatatcatatatataatatgtggttataattttttttggattttttaattttagacctaccataaaatatgtgtagctagctagctttaagagtatagtattaaggataaaataaaaagcgtaaaattaatgagaaattgtgtcatataataaaaatataatgtcatctacgttgttatagtgaaacagaaaagataattgtattaatggcatgttgaattttgtaatatggtttttaaaaacaggtaattttaacagcaagtatgccagaagcaatagaagcattaacaaaaggtgatccaaaatttgcagaagatggaatggttggttcttctggtgatgcacaagaatgtgaagaatattttaaagctacaactattaaatattcaccactttctaaattaaatatagatgttcatgaactttctgatgttggtagagccattgtaagaaatttattgtaatatgtcatgtcataatgttacatatcgaaaagtttttatagtttagtttgatagactgtctgaattattattttattcttgctagtaaaaattcgattcgtcacattatgatcatctgtggttcatttttcttttttctacctcaaatgttatgtgtgtatcccctcttaattattataagaaaaatatatcataaatatttgtacaagtgtaatactcttatccaatatatatgtttgtccccttctagataagtctctattaatataataaatttgtgatatttttaataatgatttgatttgatttgatatttattttaagaaaattagaaatatatttgagttttatttttatattaaatataaagatttatgtaattataactttgatagtctttctaattttatttatttatttaattttgatttgatataaaacttaagaaaggaagaaatattttgacactctctttgatttaatttatttaatttgatatctttctacttcttgctttccaattaataatttgtttttacatattatttgtataaatacatggtataaattatttatgggataaatatatatggcataaattttttatatctaaaatatatcatgtacttttatggtataaataaatttgtaacaaagtcagatccaaattcattgttatccatatttaattatatggatagtttaccttaaaatcattcaaattcaatttaatctgttcatttattcgttatataaagcacaaattttcttagaaaaacacatttcaagtttctccatatatacaaaaaaaaaaatccccatttagttgaaaatgaagatattaattttcctaatgatgttttttactttagtgttagtaacaaatgggattaataatctagtggaaacaacatgcaaaaatacaccaaattatgatttgtgtgtgaaaactttctcattagacaaaagaagtgaaaaagcaggagatattaaaacattggcattaattatggttgatgctattaaatctaaagctaatcaagcttttagtattatttcaaagcttagacattctaatcctcctcaagcttggatacatcccttaaaggaatgtgcattttcatataaggtaatgtttcgatttatctatcttacttttatattttaaattcgtttaataatatgaatattctttttcttttttgggccgcttaaaatatgttcttttcctttttcgaaactcgttatt

SEQ ID NO: 253 - DNA, 4472 bp, Solanum lycopersicum
aaatatgtacaatactcacatagcaacgttataagtcacgacgtccgacctctgttttgttttgattccaagaagttactatttatagaaatggtatacattgtagaagttaaaattatttcacattaagagaatactttttatcgtgttcgataaaataatacatttacggtaaacggtaaatttgaaagacatatagcaaattgtgacactgttttttgtctttaattattagaaaaattaaattgacaaagtgttaaaataagttaaagcttatggtaaaataacatgacaattttatttttgattttgatcgtgaatttgaattttgaatataagaataaaattatgttaagagaattttttcttaatcaaatcttacatataattaagtaaattaaaattaatcaaataaaaataaaaactgaaattagaaacaaaatttgtgaaatgaccttaaaagttaaaatattactccttagtattggaaaaaataatcttgaataaagagaagttagaaatgctttttttttcgagtgaaatgattttattattcacaatttgaaataataaaacaatgaaagataacggataattacaagaaaattttaatcattttatgatttttataaaaaaaatgcaatattttaattaattatccgctttaaaaatagaaataaaagtttttactattattaaatacattgtgagtagtcgtcaactgtaaattcttaaaacgtaactaataaaataatatttcaaagaaagtgtaatcatcatcattatatttatttgaaataaaacggaaatagtagtttccagtagcagacgataaataaaacaacataaacgcacttgaaatatttataatgacattgttaaccctgtggacagaaagtgggcaatttaggtaagtaacgccattagtaggggcatcaacgtaaaaacaagtgccggctctccgcaacgttttcggccctttataaaacagaagagttggcatacgcagccaaatagcttacgttacaattatacattttccgtcaaaacataaatcatgtgtggtggttctataatctccgattacatagaccctagccggacttctcgccggctcaccgccgagtttctatggggtcgtttcgatctcggtaagaagcaaaaaaatcccaacaattatcactctaaagctaagcatttgcgatctgaagttgttgacgactttgaagccgattttcaggacttcaaagagttatccgatgatgaggatgttcaagtcgatgtcaagccatttgccttctctgcttccaaacactctactggtaattttctcttccatttctagttatttctggcttttgtgtctattattttgaatttattcaagtcgacaaaatgggttaattttggaaataagagatccaagatgctattttaattagctaaaaagaaaagaaaattaaactatttcacccagctgattgaactaaaaatagccggtagatgtgtatactgcctaaaaagtaaacagaaagtttgtttgataaaataatgacaagtgcagaaaaggtattcatgttttgagaagccttaaatttacctttattatttaatcctcgtgaacattcatatatcaattttaacatagttgcggtgagttttggttggaaacttatgaaatgctttcaagacgatagaacaaagttatgaaaaatcaatcacaaatgttgttgtgttgtttggatcaatatttcccgtctagatccaatttaatgattttctgtaataagcttagatctaggcttctcagatctgtagtttttaatttgggtaggtaggctttaacatatgagttgaaacctggtatttataggtcaaaccctgtatatgtgagaaattcaattaccaacacttgagaccattttcctagaattcataatctataaagttcaaatcgtcttttatcatcataccaagagagatcttgggaaggattgattttgtgtaagtggttgcctctagcactagtgtaatcagcgaacatgtctgcgtggttgatttgtaattatgcttcttaagttttattgttatttatatagcatgctagttggtggatttatcactgaaaatttatggatgaatgaaatacttaatgattaattttatcatctgaaggttccaaatctttgaaaactgttgattcagacaaggatgctgctgctgataaatcctctaagagaaagaggaagaatcaatatagagggatcagacagagaccttggggtaagtgggcagctgaaatacgtgacccaaggaaaggggttcgggtctggctgggaaccttcaatactgcagaagaagctgccaaagcttatgatattgaggcgaggaggatcagaggcaagaaggctaaggtaaactttcctgatgaagctcccgcccctgcatcaagacacactgttaaggtgaatcctcagaaggtccttcctgaggagagcctgtattcacttcagtccgactcagcaatcatgaacagcgtggaggatgaccattatgattcttttggattttttgaagagaaacccatgacaaaacagtatggatatgagaatgggagcagtgcttctgcagatacgggatttggttcgttcgtcccttcagctggcggtgatatctacttcaactctgatgtaggaagcaactcttttgaatgctctgattttggttggggagagccatgctccaggactccagagatatcatctgttctgtcagctgctattgaatgtaatgaagctcaatttgttgaagatgccaattctcagaaaaagttgaaatcatgcaccaacaaccccgtagctgatgatggaaacaccgttactatggtacctgaagagcttccagcttttgaacctcagatgaatttctttcatctcccatatatggagggaaattgggatgcatcaggtggtaacttcctcaacacaagtgcaactcaaaatggtggtgaaaatgctatggacctgtggtcctttgatgatgttccttctttaatgggaggtatcttttaagtcaacatgccttgagttttgtaaataaggcttcatgtgagtgattttttgctgttgtataatgtacttagtgcaaatatttgatatgttaatttgatctccgttaacttgttcttttaggtgtgtctggtggtggaagaagaatgatccacagagaaccatgattaagccatggataatgcactaagtagagcagtgcataggtaattaggtttaattaactactagtagagatgttaaattcgagttttacttaaaaacaattgggctgtatggattatgagaattgatgagacctcgatgcttgctataacgttacctttttagtgttgctttcacatggaactattcactcatttgcagacagacactaataaataatagtactgcaacttgtcagacctcaacttatacgatgagtacattggtgaataagcgttgccattttctatggcctcgttttccggattcatcaatgtctattggaactcaattatcgagatattccttaatgttgtcatttgagattttgtttcaattaactcttataaagtgtatttacgtgtagattttgttcttgttaagattaattgatttttgtaaaatgaatatattgttaaaaaaaaaatggatctgtaactcgtttagatgattccgattagtaagttgaatgtacatgctggaatctatgagtaatttctttaagccattggtgtcagttatagaaagtttttcgacaagtgaatatgagttctatattattaaagaaagaaagaaatcatgttggaagtgtcgcatgagattcgtgtaaatctaaattaatccaaaaagaaaaggttagtcggcatggtaagaaaacaaggtataggttaggtgaaagacatgactggtgtgggagggggagatgtattgggtgggtaagtgacaaggttgttgaggtgaaagcattgcaaacgtggggaggcttcaaataaaccaatcttggaaatgcacgaatctaattaatttgaatatttatatcacataaaagaagattccttatttttcacgattcagactcaatttctttgtcgaaaatataatatactgtccttggtggcttaatgataaacgtgaaataaaaaggttgtggtggtatgtcaggcagatagttttggagatacatatgtggctgtccggatatgaaattaaacggccgcaggtccgtttgttattattatatggatattttatcttttatttggttacgattcctctgatcaaaactagaattagcattgaaataagttatttatttcataatagtgattgaaattaattatcatgagacaaaatgatgggaaaaaaatcgtctagatccttgaaccatttttcctattaaataagatggaaggcataaga

SEQ ID NO: 254 - DNA, 6520 bp, Solanum lycopersicum
  modified_base (5739)..(6396): a, c, t, g, unknown or other
ttatttaacattaaaaataaaaaaattaaaattaattttttacttcaaatgttagataagaagttatatgtgagccatttttataataaatatagtacatgtgagttatttttataatgataaaggtaaatataaatctcttttataataaggagtatatcaaatctaaacaacaaaattgaaaaatatatcagttcatttttccataaatatatttaatcatatatccaggggcgaacccacatggtgtccgccgggtgctcgagcacccattaactttgttacaaaatatatatatctatgtagaaatcgatagatatttgtataaaattaacatagagcgcccaatgaataaatcatatagttgatccaatgattctaggatggatacttaaaacttttttagtattgctgtaccaaggtcgaatcttattgttaacacatattttttacagagcacccacaaccttaaaataatgcaacgaccaaaattgtgattatgcctgatttagtattaatatgattcaaatgattacttcattcgtccacttttatttgccatacattttttaaaaattaatttgactaatttttaaagttaaattaaattacattaactcatattttaaacaaaagaattagatatccaaaaactatatgaaaagtactatagattacaattttttacatataatataaagaaaaaatgcatcttaaaatattagtcaaagttcttataacttaattataaaaatagaaattgtgacaaacaataattaaagaagaaagttcgaatttactctcaaactttataattccaatataatatacattaatttttattaaactaatatatgtaacttaagtaatatgtcgtgtaagtataagaaactctcccaaataggatttacatgtaaattcagattagttaaattttaatgtgaatatatatttcacgtgaaataataaatcaaaaaaacaaaaagaatgtcaactttttaaaattaaatttgatatttggtttaactcgattttccatgaacacccttagtgatgagtatataaagctcagctcatgaagagttgaaataaactaagaaaaccatgggaactccttcatatgatatcaaaaacaaaggtatcatttctttatatgcctaagtatatatttatttatatattttgtaactaaaattttatattaaaatcaacaagtgagagtttaacaaaaatcatattaaagaaaaaaaatatattaatttttaatcatggtattatcctccaggagatgacatgcaagaagaaccaaaggtgaaacttcaccatgagaaggtaactttagtttctcctttttcttttttcaacttctttatatattatttttgtaaatttttttatattataatgttcaaatggtctcattttctaattaataatgtgtctgaatcgccatgttatttatgttagatttaatacattaataacattgttagtaaatgttagaatactgactcccaaattcgcttaaggaacaagtatatttcatgtgtttctttgcagataacaataattatgttttgtaaagcaaataaaataataacataatattttatcgtagaaaactccaactcattatttagatatttagattatgatttgctttaattatacttttttaaacatgataaattatttctgttagacattttcgattcattttttttttacaaaaattgtatttgctctcaaacgtttactagttagttaagttaactatacaaaatatgtcatctcatttgattatatacatcaggctcaattaaaacatattggagatatggagattttacgattcattaacactaatgtgtatagttagaaaatgtgaaatatttcaaatggttaacttttctgtataattgacatttgaaactatatgtttaattataacaaaccgtaatcaaatgttcaaataaaattgaatgacaataggtataaggagctatcaatatattagctcttcttgattcaacttatttaccgttataattaaataatgactcgttaattgatttaatttttttactcacgtgaaatgatttaatcaactcatttatcacccttatttacgactcatgtagaataatgttctttatacttgtatacaatttactcggatattttttttaaattttttttatgtttaattaaatactattaaaatgaagaaatattatttataattgaagaatattgaattttttttccatcaaaatttacagggaggagatgaaaaggaaaaaataattgaaaaagagactccatcccaagatatcaacaacaaagataccatctcttcatatgttttaagtatttaatttttttcaattcttttttttttctcatcttcttattttaatcatctaaaagaaattattattatgtttttttttaactttaattataatattatccagcaggagatgatacacaagaaataccaaagatggaacatgaggaggtaactatatatttcaatttatttactaatttataaataatgacttattcattgattcaatttattttaattcgtttgaaatcaaactaaggttaccatattatcaccccactccctccactactcatttaaaatgatggtttgatactttgcatgcaattttgtttattcataagtcatttatttttcaaaaattttatgttcagttaaacgtttgcatacaattttgtttatacataattcatctatttcttttaaaattttatgttcagttaaacgattgcatacaattttgttcatacataagtcatctattttttaaaaaaaattatgttcagttaacgtttgcatacaattttgttcatacataattcatctatttttttaaaattttatgatcagttaaacttttatatacaattttgctcgtacataagtcatctatttttttaaaattttatgttcagttaaacgtaataaataaaattagacagaggaaatattatttattattaaaggatattacagggaggatatgtaaaggagaaaattgttgaaaaggagactatatcccaatatatcatcaagattgaaggtataatctatttatatgtgtctaaatatttaattttatttttatttttcagattttttagtaagggatttttttattttttttcaaaaaatgtgaatcattttcaagaagttaatattatttttggtaactttaatcttgatatattattctccaggagatgatgatgcacaagaaaaactaaaggttgagtatgaggaggtaactttaatttcttctttgactttttatttattatttttgtatattttactgtctatttatttcatattcacaaattatatttatcacatatatattgctttattttcttcaaaattacaggaagaatatgaaaaagagaaaatagttgaaaaagagactccatcccaagatatcaacaacaaaggtatatatcatatcttcatatgcctaagattttattttcttcttatttttcatattatttttatttaactaaatttagtatgaaacctttttttttttaaaaaaatcatcttaaataaaatattatttttgggtgactcaaatcattgaccttatatattctccaggagatgatgcacaagaaaaaccaaaggtggaacatgaggtaactacttatatttttctctctctttattacataaaatcacattagttatatgataattggctatgctaataataaaaaaacaattaatatatttataggaatttaaacagggtggagtgtccatgatctttatttttatcttgtaaagttactaagactatttccaaatagacctttagtttgagcaaaatctatcagaaaatacgataataaagaagtcacgctgaaaataaaatattaattttgtgacgtgaaagcaatatcaagagccccgtcaatttgttgtattatgtcagatgcaacatccttctttcttctcgtgaagtataggagcgcttagcacacatctcaacataatgcgcgataataacgttttaatggtgaatctatcggtatcataacaatagtatacaactttaaacctaatgatcgtctagctagtaatctttcaaaatgagggaccctaattactgacaaaatttgtgtctaacataacttatgtaccataacaataatatatcttgtgtaatttatgagtgaaggtagggtttgaaattaaacataatcaataaaattggacaaagaagatattatttattaattgaaagatattaatagtttttttcttcaaaattacaggaaggagatgacaaagagactccatcacaagatatcatcaagatggaaggtatcaatctatttatattttttataagtatttttttcttacaatttttttatttcctttggtatatatgaaactattttttttaaccatctttaaaaaaaaataatacttatgtataactataatcatgatattatcatccaggggagggtgcactagaaataacaaaggtggtatgtgaggtaactaaatttcttcttccaatttttctatacattatgtttgtatttttttttttggattcattcgaactttcttcgatagaaagtcttgctatctatatacgattaaaattatattgagtttacgataaaaatatatttaaacaattctttttttaatttcatatctaaactattgaaaatgtgtctgccctcgtaacctcggtacaaagccaactagaaccacattttaaatgattaaaaaaatcttttgaaagtgtgagaaatacgctgaaactatcgcttattattttatttttacgtatatgcaatagacaatattgaatcctcttctatttattcgtatgtttacttcctcacatatcaaatctcttagtaaaaattctgacttcaccactgtatatatcttttattttgatttttgattgcatttcatttgtttagttataataactaataagggtcttttattttatttatagcatgatgctactattttttggacactacaaggagcatacaattcaaatctcaaacttttttatattttttttctatattttttattataaaaggatattaatttcttttttctttcaaatacagaaaattatagtacgagaagatcttgctgttcaatcaaaacctccatcaaagcgtgatcctcccaaaatgcaaacagacaataataaactctagaaacatccaaaaaaaattaataaataaaaaattataattcagaacgataaagtaaaaattctgaatttgtctcccgttagaaaagtaacttcaaataaatatttgtctttctttgtattttcaaagtgtaatttggttattgtactttgagaagctttctttagattgttatgtacttgtattgcttcctttcttttggcttatttatataatataaataaaaaataaataaatatctaatgataattactttctttccttttatttatgggaaaatggtctgctatacccctcaactttgtcatttagagttgatatacccctcgttataaaagtggctcatacatacccctacttgtaaacaaatggctcacatatacccttttcctctaacggaaatgaaaaaaataataattttaatctaaatttttattatttttttctaaaaaatataatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatataccactaaataatttttttttaaaaattagaagtaacaaatataaatttaaaattaattttttaatttccgttaaatgaagggtatatgtgagccattttgtaacggtaggggtatg

SEQ ID NO: 255 - DNA, 3130 bp, Solanum lycopersicum
tgtttctttgatttctttttcatgtagcctaaaattccaacgcttttctgtcattctttcccatctttggttttgtttttcttttctcctgattagtccaggtctcattcttgtggttaaaactttaaacaatgtctgtctttcaacagtttgggtctgactgtttgttatcctttagtcacaatgctctacttcatgaatcatgaatcctttttgtaggaacttgtaaaacgtgatatgactagaagtcgcagaggtggcgtttccttcatccctgtcgtcgtggttggcttgctgggaatacttttgggatacattctcaaaaagtcatgagcattcatcattttacatctgtatctcaactcaacagaattgatcagtgaaagaaaagagattgtagccggtgatagcagcaattctcacattgtcttagttagctgcagcctttagtaggaaaaaattgtgcagctagaacctttcaattggcctatattataattttatataacttgtagtttctcgtgttggatcgtaaattgactttttgtttctactttctgtaaatatgaacgagctttttcgaatatttcaaatataatggttcaaaatcgtagttaatcgaagcatttgataatgctaggtagaataaaatctaaaaagtcaattatcgtaaagggcgaaagaagaatgactattttttgctgtagttaagggacaagttagatttaaatttttaagacgtatcgacatcttgttcacgttaagtttcacttatttgataaaaaataattgaataaaagttaaggacataatagtaatttgaaaaacccagaagcgttatgtatattgtctactagcttctagaagcgtcttcacacatcctcacgccacaattctggaacattctacatgatgcttctaaaagtttctcgagtctttttttccccttctccaagtcactaacgaaatataaaacccaagcatcacattctcattttccattcttatccaacaaaaaaaatcacaacgtgaagctttactcaatcggcaagttattcagaaatcttttggtatcagaaatggcaactcttgctctaaggagggccaccgcctcatcactattcaacaggctcgtcaatcctgttcgttctgcatctgctttccgttcattcaatactaacactcagatgacagcttatgaccaggatgatcgtggcgttgatgttgaccgccggtccgatcgatccgtctctcgccgtgatgcttttcctagtttattctcaggtaacttctccaaactctgttttactcaaatttgtgattcagtattacaattcgttggcattgttactgttaaactagaaactattgtacgtttagactcgtttggactttaatttggttttacaaatgtaactcttcaggtttgtgatttattgtatgataatgataagtcggatctgttaaactaattacaccatcatcctagtggactcatttggaatttttgggttgacagatgtatttgatccattttcaccaccaattaggagcgtgagccaattgctgaacatgatggatcaaatgatggattctccattcgtagctgcaccgcgtgcaatgggcgccggagttggagcaagaagaggatgggatgtaaaggaggacgataacgctctgtatataaaaatggacatgcctggactcgataaggagaatgtgaaggtggcggtggaggagaacacgctgataatcaaaggagaaggcgagaaagagtcggagaatgaagagtatagaaggaggtactctaccagactggaaattcctcaaaatatctacaaattggatggaatcaaggcggagatgaagaatggagtgttgaaagtagctgttccaaaggtgaagcaagaagaaaggaaggatgttttcgatgttaaaattgagtgagagcttttaagctttgccaagtttgtgcaacaattgagtgttgatgttattaactttttcaactttttagttcttagataggttggtttgtggaaaataaaagattatgtgctaaaaattggaattctgattgtaagagtttgttcaattagaaaactggaaagttgagtatacttttctcttaatgtttttgtttgttctcttttaacaattgtagctattttgtgagctatagggctcttccagtcttgggttttaaattttaaacttataattagggttttaaatagatggattatcttgaaattaagaatattaaaatgtgagtgaaataaatattgagttggttttgattggtccaagtttacattgggctttaacgagtggggttcaaatggattgaatatgattgagttttaactcgccttatttgatccgataatctcaaaagtttaacatattaatatttaatttttataacataattatttttaaaaaaaagtaaaaaatgataagataaattctagaagatattaatagataataatttatattataaatataaaaatatattttaataatttttttaaaataaattgaaattggagattgaattgagtttatttgaggatttcgtataatgagttatgttatgagattaaatctaattgagtcctgacacttgaaattttagacaaattaaatggattatctatatttgacggttatttttacacttttattcgtaatactttcatgtaaaattactttaaaaatatttatttttaagtcaaaatttgaagttaaattctcacatcatattttatttaattcattaagttctaagcttatgcaaatagatttttaatcggtcttctaatttctttattgatctagtagaaatttagctcttcaaatgagcatgttaagtgtcaactagtagggtgtgtattgattgagttggttttagattttttaaaatactattcaataattggtttggtttatccaataaaaaaatgtcagtaaatattataatttctcacttctttaaatattttaataaagtgaaacaagaaaaataatgagaaattacatcaataaaagaaaacatagttcaaaaactacaattatacgtcatggccgccaaaatataaaataaaatttctaatgttaatcttac

SEQ ID NO: 256 - DNA, 3977 bp, Solanum lycopersicum
tgtagaaagttaaaattaaaatattgtccaaaaagaaaaggaatcattcttttttaaacatactaaaaaggaaatataatttttctttttgaaacggagagagtatatttttttataaaaaattatgtgatctcatttgactagatataaataataataatatattgtaatttttcatgttagattcttaaatgaagtaaaaatattattaacctttctgtattaatattcgatttttgaatctttatcgtaacaagggtaaaattgtgtcatcttgacacattttttttttatctctgttcaaattatttcagtctatctttcctttttttatatatattttgttacataagctatttccaagttgtaaaacttcgttatcaagcatatctttcatagtatattcacacatctattagaatatactcatctctactatttttatcttttaaacgtagatattcttgaatatactacatgaacaaagttggtctagatttaattcaacagtcactccatttaaaaaagaagaagattttacttttctttttaatcgcctctaaaatgaccaattttctttttagcaacattttcgtttcggctttttacttgacaactgacatgtttaactcacaagattaactattaatttgatatatttgacacaattttaatttatattaattcaaattagatcattcacataattttaaaaaaaaatatcttaccaaaaagcctcaatacttgaattttattgaattatcaaacatattatagcaatacatatatatacaaaaatatattattaaatactttatactaatttattattgtcgacataataacggtggtcctgttattgcctggtttctgctgtcaaactctacagcacgttttattttatattattatacatacgactagtttcaatccaccacgtgcaaatttaccccctattttttcatctatatatacacttcaaacccatcattatttttttgtcaaagaaactgaaactaacacaaagcaggagcaggagcagcaacaaacagagagaagaaaacagaggaagataagaggaaaatttatcgaattcgaatcgagagaaaaggggaagtgaagttgcgaagagtgagaatttcaaaggaaatgaacaaaggagcaaacggaaatcagcaattggagttaccggcgggattcagattccatccgacagacgacgaattggtgcagcactatctctgcaggaaatgcgccggacagtcgattgctgtatcaattatagctgaaattgatctttacaagtttgatccatggcagttgcctggtaatttttgactcttcctccaatttttcatagcttgcaaagtctaggtcaaaaaaaaaatcgaaacagattaagcttcgcgtttgatcacagtttttggatctgttccgccatggaatttgaaaatcagatcaagttccttaaaacaagtttttcgacttatagcatagcaacacaacttcaaatctcaaaaatcacaatttcaaaaactcatagatttcaacttctatattcaaacaggagctaaatttcgaattttaaaaaattatcttcaaatatccgtaaaagttaatcttcgaacatttttaagttcctaaaactgtttggttctttttctgaactttattttttgttggtaattgcagagaaggctttgtacggtgaaaaagagtggtattttttctcaccaagggatagaaaatatccgaacggttcacggccgaaccgagcagcaggaaccggttattggaaggcaaccggagctgataaaccggtgggaaaacccaaaaccttagggataaagaaggcacttgtgttctatgccggaaaagcacccagaggtataaaaacaaattggattatgcacgagtaccgcctcgccaacgtggaccgctctgctggcaagaacaataacttgagggtaagtccttcttcagctttaattttttattttcggagatgagattcaagattcgagtaatatagtatggtaaaattactgagtttacgtgaactatactcacatctctaatagtgatatctcctaagatttacaatgtttcaaatgaaaaatagtggaagatttcactttaattatcaacaattaggtgtggcacccatttaacatatagtaataagtaaaataaaatggtcattatattctgtaacttatgagtgcaaaatacaatttgtaaattgtttattgattatgtgatttgacattattgcagcttgatgattgggtattgtgtcgaatatacaacaagaaaggcacacttgagaagcattacaatgtggacaacaaggaaactacaagctttggagaatttgatgaagaaataaaaccaaaaatattgcccacacaattagcaccgatgccaccacggcctcgatcgacaccagcaaacgactacttttatttcgagtcatcagagtcgatgactagaatgcacacgacaaactcgagctctggctcagagcatgtcttgtcgccatgtgacaaggaggttcagagcgcgcccaaatgggacgaagaccacagaaacacccttgattttcagctaaactatttggatggtttactaaatgaaccatttgaaacccaaatgcagcagcaaatttgcaactttgaccagttcaacaatttccaagacatgttcctatacatgcaaaaaccttactaaaattgtataaattcattggatctaaattgagtgtgatccatgacattttctttgttctttggtggtgtaggtcaactttttattaagtagtttagagaagtacaaaatgctagtcaaatttggtgggctacagcacaaatgagccttgataagcatagccaaagagtcgtatagaagggcttattattattgtaaggtatgtaaaaacaaatgaaaatttgttaatatcaagttatcattcttcaaatctctgtgattatgactctcctacactggttcaaatagaaattagcatatttaagagctcagggttcaggggcaaagttatcgacatcgatgtgtctgattcatgtaggcatgagagctaaaactttctattgtaagatccacaataagacagtcgacttgggtgaaaacaataggaaaaaagcctaacaaatcatcaagttgagttgttaacactaaacagtgacgaagactctttcctacatacaacatagatgaatgtaacaaataacaaggcaaaacatctttaacctagcagttagtaagatttcgattacctcatataagaacttcgcatcgtccttgatataaaatttaaaagagcaagaaacgaaatgaaattccttacgtaaggaggagtgtggctgcgcctcgtttcatcatcatatgttagcagacacttatcctttccagcttccgctacatactagtgagtgctgactcctcggtaactgtcaacgcacctccaaatggactgcaagccagtatgtacctggagtttctccaagtgtgtcctttaattaagtgtcaatcgcctccatatgtcgaacattacatgattgcaatatcatcctagtctcgagacaatccaaacactaacctgtaaactgtaatcaagttgctggttattgtctctcctgttgattctgtctcttttaaatcaggatgtcctcctctacaactggggaagtggagctttgggtttcagttatgggcctctttgaacagtttggattcctttggggtctttgatccagtttcacactgtctttcctatctctttttcacattgaaggacataatggatatgcaatttgatatgtatgactaccttgcaaaacaagacgtaacactttgagtagggactgaaattatgtacgagatatgtctgtctgcacttgttataccattttctgtagtcgaaaggaagtagacaacaacaaaaacatacccaatgtagt

SEQ ID NO: 257 - DNA, 3374 bp, Solanum lycopersicum
tctctcgctttatacacagaagtgtatacattgtatttttgttttgtataaagcgagataaaattgtctatacacatgcaaaaatatatatcttcgtgttatacacttaattatacaatttacaaacatttttctttaatttaattatagacaaatgtaaattttatataaatattgtagtgaaaaaggccaacgcattatataattatatatgtatagcgaattatactattttatatttgctataaaacgcaattatataaattttgttatagcatacgaatataaattttttatttgttatgcgttgaacgtgccatcattatacaaaaatcattctaggaatatgctcacaccttttaatttaaggaatcacaaatcacaatatgcattcatttatttgtttattttttcaatcttaataaattcattagtatatgtggcactcctagcaacgttaattcactaattattgacacattagattatctccttctcattcaattccaactaccacattcacacgataaaagttgcacatctatttttttttaatttaaatttattttattttatttacttaattattcaacaaaatataaaaataaagtgggcccatcatttttgtcataagtaacgacacaaagttaccgagcgtgcatctacctggtatacgtgtctgtttccccgagcctaatcctcccgaaccaaaaccgaaccggaaacttccacggacccgccgagccacctagtcccttttgacacttgtgtccaaaaatcagtgcgtaagcagtgaccaaatgtacccccaccccctccactaccccctcaaactcaattttttgcatacgtgtccactttttttttgatataattttagttatcattttatttctaattattttaacacgttttttctagatcccttcagcttatcttcgccacgtgtccttgttccgttttctatatatttagctctctcccttgtgaccgaagtttcaactttcaaccgttttcctattccttcaattctattcaaagaattcagaaaactctgtctttagactgaaataagaaatttatatttaaaagaaaaagaaaaaatgacagcagctgaattgcagttacctccaggattcagatttcatccaactgatgaagaacttgtgacgcattatttatgcagaaaatgcacttcacagccaattgctgtaccaattgtagcagaaattgatctctacaagtttgatccatgggatcttcctggtaaattagtttttgttagtactgaacagttgaaaatttctgaaattcagatggatctaaatttttttgtttgtgttttgtgttttagatttggcattgtatggagaaaaggagtggtacttcttttcacctcgagatcggaagtatccgaatggttcacgacctaatcgagctgctggaactggatattggaaggctactggtgcggataagccgattggaaatccgaaagcggtgggaattaagaaagcattggtgttttattctggtaaagcacctaaaggagagaaaactaattggatcatgcatgaatatcgtctagctgatgttgatcgatctgctcggaagaataacaatagcttaagggtgagtgtagaacagattaataatttttttttgacgatctagactctgtttttccgattgatttttgacggtttctgtctcgtttacagctggacgattgggttctatgtagaatttacaacaaaaagggatcgattgagaagaacaggaaaatgaacactacctgctacatggataaagttggatctccagaagatcggaagccggagattctaccaccgctacctccacatcctcagccgcagcaattgcacaacgatttcttctacctgccgtccgattcagttccgaagatgcactccgattcaagctgctcggaacacgtgctctcacccgaattcacatgtgaaagagaagtgcagagtgagccgaaactgacagattgggagaaagctaccctcgatcttccatttaattacatggatgccactaccggcgccacaacggtggataatagcttgttaggttctcagtttcagagcagttatcagatgtcgccgctgcaggatatgttcatgcacctgcacaagcctttttgagtggggccaccaatggattattttcagccgcaagtgtcaaacgagactttaacgtccgtgactttgcacgtgccgccgtagtagaataataggagtagcatcttctgcgttcacattggcaaattgtgaaaacaacatttgtacatgtagtagatgatggggaaaaaaaatattattattagcaattaaaataaaattgcaaatatgaaaggaaaaaaaaaaacaccctaatcaagtttatatagtacataatgatcatgagactttttgtactacatgtgaatgtacttttagtgaatgggtgttttattaaactttcatttttataattagttgtttggttgattcacttttgaatttggctttggtgattgagccaaattggggtatgcaataatatcttatctatttccttgacttctttgtttagtgaaattatcatacttcgtctgtgttaggctttatttctcttttatcggctcaatctaaatatgtatttgaatggttaagattttttaatgaatatttgaatgattttttaacgtatatttggatgattaagatttttgcgtagatttgagtaacattgttcatttttaaatataataattattttaatttaaataaaacaataattaaatattttattaacaaaatattaaaaaaattattctttgatagatattaagaaatttaaattatgaatatttttttttaagtttggcgaaaaatgtaatataactacatgaattacatatataaattaaaataataaaaataatcattcaaaaaaaagttaactatcttttttgagaaaaaaatattctaacataaactaatcttaaatatgtaggtgaaacatctaatgaatatgatacattcaaataattttacaaaggcatgataatctgatttctaacaaattatatatataaagtttgttttgcactttaatcaaataaattttgtcaatatttgataaacaagtagctaaaacaaaaattaaaagttcaaggaaaataatttagatagcttataaagtgagataatgaaagaggcttgaatttgttttttcttagagaaaaaaagacggaacataatttgttttaaaaattaaaatgtctttaaaataatttgaatgagaataagactatgatacaaatttgattcattcatatcttttcaaatccataagagaatcta

SEQ ID NO: 258 - DNA, 17928 bp, Solanum lycopersicum
agtgatctggttgaaatagtgaagttggttgatattagtagttaatggtgttgatgatggtgactgaagaatgcatggtgattgttaatgcgtttgggatagttgtaggagatgctagttatggtgataagggtgttagcagtagagatataatggtgatagtgactaatagcaatagtggaggtgtcagtggtggtggtagtgattgatgaatatatggtggtagttggtggcgactttgttttgatgataacatttatttatagtatgaattgatggtatttatcgttgtgatagttgaggtggcggtggagtaatggtgacagttaatgtaattataatgatgaaggggataagtgtagccgtagatgacattaatggttagtaacagtagtagttgtgataacaaatttgtctagtggtagacgacgataatgacagcgatgaaagttagtgatggtggctaataattatggatagagcaatggtatatattatctacaacacaatgtctctcaatgatattcagactctattcaaaatcttaatgattaaaatgtatacaaattaaacctaagtgcttcaaatattaacagaaaaaatgtatttaatgatcgtttgaaccatttagattcatacctccataaaaaaaaaaaaaaagagacctaattatttacttgcatgtgttagaatttgagttagatcaacctttgagctttgtcattcggttagcttatttttggatcaaacttgaatttgatacacttaaatcgaaagtcttttggaaataatttctgtagcttcactagataatagtaaggtctccatatattatacctttttcttatttatagaattttacggagtatgttattgttatttattactaagaccgagaatatgttatttattataaataaagtcaaatataattttcaatgatcaaagtcataattttcatggacctttctcttatgtttattcaaagaacctcctgagtggaagtgttttttttttaaaaaaaaattgaaacaaaactctcctcatctctctaacaaaccgcagaaaagccttttcaaagaagctaaaccggaagaagagtaaacgctccgtcaccggaaagctgcctaggtttcgccgttgagtaaattgtaagatcatatagttgatcgcagtatatagtgagtgtttacttggaagaatcggccatggaggatcatcttcagatttctccggccggagcaaaggcgattccaggaaaagagcaacaagccgctggatatggcatacttctgcagatcatgatgcttgtactctcctttgttattggacatgtgcttcgtcgtcgtcatttctattatattcctgaagccagtgcctctctattgattggtaattttgcatttaggtttatagaatatgagtctgaaaatgccaatatgaagtattcttcaatttttagtcttttttgcatttcaattttcccctttttctgtgctgggccatataacttgactctgaaaatgcctaatatgactagcattttccataacacagttcctttttttcttctggatattgttcaatttcatccttcttttagctttttcaatgccaatatgagaatttttgtccatacttgggaatgaatttttcaaattgaggtacacttcagctggaatttgttgggaacttcgttgaacgagtttgcgtttgttgttgtgggtagtcatttcagaacacagtggaagcagagtattcatacaggtgttattaactagttgggagttaaattgttgttggtgcgtttagattatgccaaggagcctggttagtttgtttagatcattgtctgtttagtttggtcttgagatttagggaaaccctaaattgagtattagaatgaatagaatgctatcataggtgaaacccaattagtttgggagtgcgacttttttttgttttgttgatgttggtaatagtgcactaatcttatgagtggtaaaatgcaatttgagtactgtttttacaagcttgttcagcattttccatttacttgaccaattgaggtaccttttagcttggggcatactgagacctatgatgcttggattttctttgtggcaggtttgattgttggtggattggctaatgtttcagatacagaaaccagcattaggtagttcactgaacttttattaccatttggttcttgaaggtttaatattttctatgggttcgtgttgttggacttctgactctttctttttctcttcttacttggcagggcatggtttaacttccatgaagagtttttcttcctctttttactgccaccgatcatattatatccacatttaaattctttcttgcagaaaattttctattgtttttgttccatgtactgtagttaaatattcagcttagtttggaatttatgaacaaaagagcttttccttgaccttctttgcttactcagtcaggatttagtctatcacctgtaagttttcttctcttggtacttactcgatgtgctacctgcttttgtttttgcattgctaacatcatggctttactgatgctgtaagcagaaaccattcttttcaaactttggagcaattatcacttttgctattctaggaactttcattgcttcttttgttactggcattctggtgtgagtattgcttgcgtctatgattttcttagtactatcagttttcactcttcatataattgatcactgtgaatgcatatttttgcagttaccttggtggagttacgtatctcatgtacagacttccatttgtagagtgtctaatgtttggagctcttatatcggcaactgatcctgtcactgttctgtctatttttcaggttagtttttttttttattcacgttctttatagtttcaatgaacagctttgcttcctgtattagactagtcacttttgaccatcttctctttttcatttttatgtttgtttactttggtacaaaccacatacgttgacacacaaaattggtaaaaggaatccttccattatgaaaaaggcaacctttttggtgacatcttcactgtttgcacgatgatgtcattgatcatgttagcgcttaaatttcgcgtctatgaatgccaggaacaatagagaccgaagacggctgggtaaggagtatgagatatgttagatcagtatactgtcatgaatcagaacaggagggttgtgataggcacttattgatcattcgtctcatcaagcatacccttgctgatttaacaaaacaaatgaaagggtctctgggcagtcccataccatcagataaaatcataaggaaaactgtaccaagtcttgaacttgaactgagggcctaatcatatcataaatcggtccactagggacaaaccacaacatactagtcaacttgtacactgacagaggacgcgggcatctaatcggaacatataactgaaaaagggacgtaatttaaaattataaacaaattaagatcgacccttacaaaagaaatgagatgcctacgctgatcatgaacatgctgaaacatatggttctatgtctgcctctatatctgtacgaaaagtaagaggtgagtcatctagacctgtaagctttaccaactatccctaaaacactgacaccggtaattgaagaaaatgtgcatgcgtgaacggaattgtagctgaaagaaaatgcaattgatgctgaattgaactgaaccctgcaggaatgattaactgaaaacttcaactcacacctctggttcctgtttgaactgcatgaatgcatatgttactatgaggttataatttggggagggttctatcaagaatctgacttatctcatgatgcccacctcatagtagagcagtactgtacttgagttgggacttctagcaagccctgaaatagccgttatctggttgtgtagacatagtctaatggaaaaaatataatccacacttgtacgtgtggtttgggatggcaccactcaccggttgatgcaaacatccactcaatccttctgtcgcctcccataatgcaactttggcaacacatgtattgcatcaagtattaactgaagctcaattatcttaattttaacttgcaactatgtagaagcccgtccctacatgtaaatggctgcccaattcaccaccacgacaatcatacagttcatcaaatagggtgtgatgttatgaagatttaatatagaagaacaatgtgtattgtcaaaaaataaataaacgtagaagacaatgccttatggagaaaggtgattattcaaaatatagacagcaaggtaactgaatcacgaagaaagtcaattcttcatacggaacttgcacatggaaagttatcaggaaatactgggaggaatatgctctaaacattaggtttacaggaagaaatggaaggaaaatatctttttggagtgaaaactggttagggcctggtcctttcgaagatctactctctgatttatttttgttcgactacacctgaggcttagtattcaggagacatgaatctctgaaggatcgatttctttcaaaagagtattaaatgactggaggttggaaggatggatgaaatggtgaagacattggacggttgccagcgtaggggtgggctgaagcgtaggagtgctggcctcctaagttctgatagtttaagtttatcaagatcatctctcatacatacttttttttttcttgatgaccgtagtgtccgggccagctttcgctcacctcgactaattcaacggtatacctaccacctcccaccaataacaggtgccaggtaactttgttctccaaggctaggacagatgggaaggatcacctaatgtttttttatctccactgagttttgaaccttagaccttaaggttctcaaacacttcattgaccaccaggccacaccctttggtgcacttatttgctgattttcttctgtacaaaattcctcttttttgataccgattcggtagtgtcatgcttatcaggtcttacccttaaaacctctatgtgacagctactcatccttgtatgaaaaacctatatggataactttagtagagtggtttagagaacacgaaaatcaaaaggcctatataaccaaataccgaaaccgacgatcgaaattctgaaatttactcccgaatattttaccagttactgaatatcaaatcaccaaaattttcagtccgacttggtaattcggtgatttatgcccactcatatttccaggatattaagaattctgaggattcagctatacagaagggatgaaacaacaaaaggttatcagttagctctggctctgcatattcccaactctcaaaaccaactcaagccccaaaatggcttttggaagtttatctggaaaacctaagcttccttctagatgacatgtttcatttggcttgttagggaagcctatctggaccatgaaatattacagaaaagggtatacaactgagctccgactcctattttatcaagataaaaaaaagagcaacactcatcttttcatgcacgaccaaggtgactgacatgttgtgtagttatttcttgccttagttgagacaagaatgggtgatgacaaggaactcgaaggatctactgtggtgatggaacacaaataaaacaaaaaatagacataagaagtggaagataattgaatgctttgaagacagatgaaactctctatgtgaagataaagatgaattgtttagtgctttactatttttggtgtaaacaagaatgtctagaaaatataggatctatctttgatgtcctagaatacatatagagagttttgtttatcttcctattgtaatcccttttggtctgggtatctacacaacttgtgtaagtatcattgatataatatattgtttaccatgcaaaaaagaatataaaaattgaggatgtttctggcgaaggattatttttttgagaattagtactattgtattctttagcattgagaatgctggccaccataaaaaacatgttcataaagaaagttgactctagcaggtatcctgtggtattagttaaggtgcgcacattcttgtccggagatcacaattatcaacaaaagaagaagatagagacttatagagaagcgcttggacaaagacacaatccgtagtataacgtaggatgtacggtaagcgtaagtttggcaatatttggagaagggtaagctctgatcccattatctgccgagtttaaagatgaaaacaacgaggttcttggttttttttaataaacaatccggagaaacagtgagaagagggaggagatgaataaggaaagtaagtaagatagcttgtcagcaatatacccattgtaccaatgtcgacgagttttatgagttgagggattctgagattttggagaaatttttgaccgtgatctgtagaactctctcccctacttcacagaacatctgaggatcttaaatctacagctcttaattagttaccttgctagggatcgtagtgtaaacggataagaatcaggtagacatctccactgggctactttccactagacatctttcggtcaaaagaaatttagtggagggcttagccgtccaaattatagatctctataggaaatgcttaaagggataaataagtctatagagtagccaatctatccagaattcacaacaatcattgtgtcttttccaaaagttgtaatactcttccagaaagggtctggaatagtaatgcgctgattctagtaaagttgcatttttttctgcagcaatagtgtgtttattctcttcatccagaagaaccaaaatagatgcttggggatgatcactcttattttcctctatgtaaccttgttattgtgtttccagggtaggcatacctcttgtgacatctatcacagtccattgattcaatatcaccaaatagtgaacctcagtgaccaacctgtctaaaccccacaggaagcaataccagcgacctattcaagtagctaaagacaaaatatagaaatttaaagcacaagttattttcatatacatggagaactttcccgtacatgttcgctcttgggttggataaggtttagcaaggtagactacttgctacttaggtcaggttccatcagaccatcactacctttaaagaggaaatagttatgtcattgttttaatctcctctttcagcttcttgtcatttgttggttgaatttatttgcttgaagccaatttagtgggtttaggtagtattctgatagcattgacagaaaatatcttgtgttcgacagtatgcttggatatagtgtttgttaatagagtaacttgagttttgtgcctccacatgactgctctttgggtattttagatgatgctacaccaaagctataagttatgcatttatcataaaccaggtatagatacaacaacaataaaaaaataactcccaatcccaatcatgttggatcgactataagaatcctcatttactatgtcgctccatttaagctcatctcaggcaaataaactaggatatataatccaaaaaatttaatagatcataccttgttgagggagatacgcaaatcgaagaggagagtcacaattgctgaggaaaactcaatattaagaagacatgactttgaaaccttgcggtttcaatagaaaagatttaagagtgtaacattggagaaagcaaagtgggagaagtttggttttgtcatggtctattaccactctctgtcgttggaggttgaatatcagatctgttgggtattttcatttattatttgacgatcaatctgttcgccaacttacgtggctatatcagatctgttgggtattttcatttattatatgacgatcaatctgtttgccaacttacgtggctttttaaaattttcaaattgatataagtaggtcttaagtcttaactatttcatcattggctaagctttgttgtccttttgttgatcgagttactttctttgacatgattgtaggagcttggcacagacgtgaacctatatgctttagtgtttggggaatctgttttaaatgatgcagtaagtcctactcattcttttatgtgaaagttggcgtttcactatgttgttgacttaatttcctgtatattgggattttaagttgtgtatatgcattgtttaccaaaattttttattttgtgtatttatttctttgtttttctttgtatgctgcacacttggaagatggcaatttccttgtacaggttagtatacgcaagcttaactgtcgcactggtattgatattcaaggagcatctgcacatacagatagatccagatggattgacaatcaagaactggattgttttgtaggacaatgtcactggtcagaagccacatgtcaactgatcagaattacttcatgataaccatccgatttgtcgaaacatttatgggatccctgtcagctggttagtattttgtaccatttagtgttttttctcatctttctttactcagtgaaagctagtgttggtataagaaagagaaggtcaagcaggcgttgttttaagaggaaaaaagcttttttatacaattgaaattatgtcattttttggaaaatcctgagaggatgcactcttttcaagcagtctgaatatatttcagttgtaactgctggagcccagaaatttatccatgggaaaaaaaggaaactgttggagttagtatccatatacttacttttgttctataatatttcttttcaatagtttgactttaatttttttttcaaatcaactaacaacctactgctctgattctacaggtgttggagttggatttgtttctgctttgatatccttcttttttactttcttccgttagtgcatctttcttgcattttgtatgcacagaaaatgaaccaggaagtttacctccttagtgatttttaacctaaatttgtaggtcttctaaagattatggtgcctctattattactaacttttcgaggcaccatgattcttatttaataagtttaaaggttttattatatttagtataaatgtgcatttgatgctttctagctcataatgtgttgtggtgccttgacttcacgcaccttttcaaatatgctggcttggatattgacaagtaagtcaagtattttgaacttttttgcatcatctgcttctgactgatgatattgatggtgtttctactaattctgttgtcagtcttcagaacttggagagctgtttatttgttctctttccatatttctcgtaagtaactacattagattctcacttttttacatcctatcttggttttgtgcctaacatgtattttatcatgaaccatcatcttccagatatatgctagcagaaggacttggtctctctggcatagtgtctatattgttcactggagtcgtaagttttcatctgcattttctcttcttccttttttccccctatcattttctcttcctgctcaatgtgcttagtacttatggattgtcttttaggttatgaagcgctatacgtacccgaatttatcagaaagttcacagcgatttgtgtcggcgttttttcatttgatatcatctttggctgaaacttttgtgtaagtcgggcattccagtttttgaggatttgttatatttgtacttcccatttttgttaaataacttccgtaacgcttgtttttgtttaatgtgcagatttatatatatgggatttgatatcgcgatggagaaacatagttggtcccatgtgggatttatcttcttctcaattgtatccttcacatgtagcctcctttatatattgtaactcgttccttaatatttttctgaatcaattgtttttcctttaacttcttgttcgccccagctgttcattgtgattgcgaggtatgtttgttattctgtttcttgttctctggggttactcttggttgcacgattttatcccaagctcattgtgccaatgcctatgttgctcttatgttttctccgtattttggattaaattatggatggaatgatctcaaggttgtaaatccataattgctaatctttttcctctctttcattaagggctgctaatgtgtttggttgtgcatatttggtcaatcttgtacgacctccacaccaaaagataccagcaaaacatcaaaaagcactctggtacagtggtaagtggtgaagaaattatttttcagtctatgttttggctttttcaattttttatttgagctcattatttatgtgtatgtcaaggacttcgaggcgctatggcttttgcccttgctttgcagtcagtccatgatcttcctgaaggacatggtcagacaatattcactgctaccactgccattgttgtattaacggtaggcaaacttgctcgagttttgatttaattcttgttgatggctatatgcatgaataaagtttcctgaaatcaagcagcaaagagaaactaatcgaaataaactgactctactgtggttgaggaactgttgataggatgagtacgtagatgcaaacattgaagtctgattagcagctgaaaagatcctcctgcgctaattgcaagcattagagtagctggtcaaaaagttctattgtgcctcttttaataaatgaaattgggtaaaaattattttttctaccatcaagtgattctaggcctatgcatcaccaaataacaaagctcagttcttttactgcacgtaacaaactgagagattatgtcatgtatatctgtctcccaattgcataatgttagcaaaagtgtacatctaaattttgtccgagaatgcgatagttcttcctcaaaaaattctctggttccactctttccatatcatccaccaaatggctgcagggatgatattcggtgttctatatctcctattttggtttcctatgcgctcctgaaaccaacactgctctttggtacttcttggcaatgcaccaaacctctcgactgtctgcagtggatgaatagataattcgggggcctttgataaagaatcaatggaaaagtactcatatcctaactcaaaagcacacatctgttacatctaacaattcctctcctttgtaagtgttgtgttggacatgcttcagtgctacctgccatatcaaagattccctcaggagggttcgctattttttaaaaataagcttccatggacttgcatttgcattgctggacatgaacctgtatgctgaactgtgaaatggctttttctactttacatatcaaatagtctggaatgcttgtgttatttgagtgttgctgatgtgctggattagttgacatatgctctctagtttacaatcattgcagtgtctcctgattggagtgtcctgtccttgtgttagccatattctgcaattacagctgttgggttccaccagccttaaaatttcaggggactgttcctttaggggacaatggcgtcatctcctactttaaactctttcctacctgtaagcttctcccatagtggtctaatctgtaagacatgtttacttagtcatccatcgcctcccatttcatatttttcttttaccacttctctccagagaactctttttggtaaatctccatagccatttaaacagaagaatttggttgtatacttcttgatgcctttattctcagccccccttcttttctggctgctgtggtagtattcttttctctacctttttaagcattgagaacatggacaaggtgtaaattggcagcacacccagcacagaatatatgaacaccagtctacgtccataaatatttttattttcaaatcgtcaatttcctttcacatttttccaagacccgttctcaaatattttcagcttgaaattattgccctgtggcatgccaaggttttagattctttgcagcctaacatctgtgagtccctgtattgttatctacttcgttgtctggaatagatggctttttgataaatatatgtgcggcttacttgccccttcaaacagtagaattaacacaaaaaaattctgttcctctacttcactcaaaactagagtgtcatctgcatattttctccaatatttctcatagtcttattcctagtttaccaaatgcccccattttctctagagtgttgcttcttcgcctctggttctagtcttttgttggtcaccaatataatagtttacatatttaccattgtttttcaagtaaataaacaataaggaaaaagaaatcaaggttagtttgatcctttaggtatttcatcctagtagagctaatctcatgaaagttatcccacgttggatcctgttgaaaaaatactgccatgcaaggtgagagagaagagggcatcacagacgaggatgacaaagtacggctggaggaggcactcattagacaggaatgacagtcacactttcatgaactcttgaacgaagaaggtgacagatgcatcatgcctgggatttggagcactcagagagacaccgtgattttgggtgatgtaggtgtataaagaggtggagcgtaagggaagagcaaccgggccgaatgagatccagatggaatttttgaagagcgcatgcaaggttggtatggagtggctaactgtgttgtttaatgtcatttctaggacgacgaaaatgcccaaagaatggaggtggagtacaatgattctgttgtgcaagaacaagggtgacatctagaactgcaacaactatagggttatcaacttgttaagtcacattatgaaagtttgagagagggtgttggaggtgagggtgtggaaatatccatgaaccagttcgagttcatgcttggacattcaactacaaaagccattcatttggtaaggaggtggtgtagcaatagagagaagaagaacttgtacatggtgttcattgacttagaaaaggcttacgacaaagtttcaaggaaggttttatggagatgcttggaggctagagttgtacccgtggaatacttagcgcaattaaggacattgtacaatagcaccaatagggatcaaacgttagccggttttgtttgccctgtgatagatgcattgacacgataaatttaaggtgaggtgttgtagtgtatattatttgcagatgacatagttctaattgatgagactttggacagagttgacgttaagctagagatttggagaaataccttggagtcgaaagggttcaagttgagcaggatcaagacagagtacttgtaatacaagttaactgacataatacatgaagcagatacggtagtgaggcgtgagacttgtcatccaaaggacaggaagtttcaagtatcttgagtttatgatccaaaggaatggagagattgatgaggatgtcgctctctgcattcatgcaaggtggaagaaatgaaggcttgcattcgtagtcttgtgtgataagaaagtgtcatcaaaacctaaagataagttgtacaaaatgatagttagaccaactatgttgtagtgacagagtgttggttagtcaaaactctcaaaaatgaggatgttgtgatagatgtgtgggcatgcaaggagagataaggattaaatatgaggatattcgagacaaaatgtgagtggcttcaatggaggaaaagatgcgggaaacgagactgttatttcgggcttgtgaagaggagatgttcggatgccccagtgcggaggtgtgagggttggctactgatggttctagcataggtagaggcagaccgaagaatattagggagagtagataggtgattagacaggaatgagacataacttatcgaggacatgacctagatagaaggtagtagaggatacaaattaaatagaaggttagtaggcagcagtgtgttgttttgttatctgtccatactagtagttatagtattgctcctgtagttcatggtcctttaacttctattattatttgttgttttgtacttcgattatcatattattctgttgctgttactgccccattactatatgttatttcttgtactcctattatttgttacttctctttcagtactgctctttggacttttttcttcgaactaagggtctatcggaaacaacctctctacttcttgaagtaggggtacggtctgcatacactaccctcctcagaccccattttgttggattatactgggtatgttatatcatactccctccattccattttatgtgaggtagtttgactcggtacagagtttaagaaagaaaggaagacttttaaaacttgtggttcaaaatgaacaacaaaaatttgtgtggccgtaaatcatttcattaagggtaaaatagacattgtatagagaaatgcgtcattctttttaggactgaccaaaaaggaaagtaagtcatataaattgggacagagggagtatcattatattggtattgctcataccggagatgagtccatataaaatttagtgaacttaggactatttattcccagttaccaaattccccttctttagaatgttgctccatgatctctgattctagttttttgttggtttcttattaagtttcaattaacataacattgctatgacatgcaaaaatagcctatattattcttatgcttgtatggctgtttcatacttatcattcatgacttttatgtgtttgataggaatttatttcttcttcgacatccaccacaaggacttcttctctaggacattaatatcatgtgaagatctttctcctcttcctacaaactgtgattaaaatctattttgcaaaaatatagcctcaagatctaccgcgtagcctaagttggttctctgtcggcctctaatgcctccatgtcaacacctcaacagtttttctcgaagtgtttcatcatatgactccgaaatttgcaacttatacaattttgaatatatctgttagacttatgaatttggacaagtgctctttctctagtcgtttggcatctttccactcctttgatataacatcgaatagttccactccgacctctccaaggtaatctttttcaaacatccgttaggtaccatttagaccacaagttatgctaacctcgtattttcttggtgcttacttctcctggcctaattatgagtgtagctacaattttcatcttccacagttgtataaaaaaatctatacagttcttatgatcctcatttgtaatgtatgtgttagataataggaaaataatggtttaacatttcacaccgaaaggcttctgaaaacatcacattgcacaagtaattagagaactctatgttggatgaaatcagagaacttttgattaaaagacacaaaatgatggtgaagaatgaatgtctgtgttctgctgaagccatgcactcgtacattttctgaaactacagtccttcatgtaaactcttctcctgagatcctattgaaaccccaaaattttatattgcaaaaagtgggtttgacaattcacatgtgttattgtacaatcataatgtgtcagagtaaagttttgccaatatatggtttttccttagcatgcatgtagttgaaacattactgcttcgaaattattttacaacaaaccccgaagttcttttgttgctctagaatatttcacttggattacagttgcttctttctaccgttcttcctccacactggatggatgatctcttccacaatatatgatataatctgatcaaattccgtctgcaacttttcaggttttgattattggaggatcgacaggaaccatgctagaagctttggaagttgtgggtgatggtcaatctggctccatggatgaagtaagtgcattagccaagctgtttcccaactttgtaacaagttacaatgctttgctcagtgcacttgttctttctcctgctattttctgatttcagacctttgaggggaacaatggatatatagctccttcttatagtgatgaatcttatgatggtgaaccgtcatcagggaacaggttcaggatgaaacttaaggaattccacaagaggtaatgttcttatgtttgtggagcaatgttaagtgttgggcgatttaaatcttggtctctaaatgttttttttcgttttccacccagtgtccagtacctacattgtcctccttaatgttattaagtcatcccagctaactagctaactggatagacacttctgcgagacacaggttgtctcatcttttaatgcatttaattgttttctccagtactacttcgttctcagcattggacaaaaactacctcactccattctttactactcaaggtggagacgaagatgaaggtaattctttctacatgctagttaccatttacctacattgcttgttgtgctcattatattgtctaatcatttatacagttgcgaacttgataagctcatgcactatgacttgtttttttctgatacatagatgagccaattatgcacagctccagaagagctggttatgacggccactgactttcaaatagcacaatcaaaatttcaagatggcaagataagtacgaaccacattttgctgcaaagataaacttaacttcaagtttactcaacggataatgagtggcttgttgattgtaagtatgcatcaattatgacgagaagtttagatactttaggggtacaaagaataacaggtggcaattcagtataggaagtttaggatttagcatacctggcaaagcaaaatcatctgatatcccttgtatatgaatgttcaaagccaggattaggaacggaaacagaactccaagtggcttctatatgctaaaatggcgatatgattcgctgatctttagcttttatgaattagtgtaaagtaattgcatattccactaagcttgaagagtgttgcttcgtgcagcccatttttatcagcttcattttcacaagctttatggatcattacagccttgaatagtctgtttttaggttactgttaatggggaaaaaagtatgtagaaaaattcaaccattttagctgttccaagatttggcaatgttaagttgtcaaattatttgggctttaaactagtaataatgattgactagcttgttggtgtggtgattcttttccttgctaaggagtttgtcgttgagctatttgagtatacagtactagtgattttggatatgctataagcctatgatcgtgttgaggggtagacatcaagcagcggtgcacataggtcgatttgatttgatttgatttttttatctatcaaatttatcagttacggtgcttttaaaaattataaaccaggttaaaaccaacaagagttggttttttcgtttggtttgttttatgagtttttggctaaaatcattcttaaaattgtactcctgttcacgggtcggtttggatcggttattggtcaaaacttaatcagttttaaaattatccaaagaaaatacggacaagggtctaatatacccttaaggtattgaaaatggtacaaaattacccttcatccacctattggttccaaaatgtccttttcatccacttattggttctaaaatacccttgtcatccacatttaggtttaaaattgaccattttttaattgttttaaaattgaactctttaaatatttttttaaatactgggcgttcaactattaattataattttaatttattaatataatttataaaccaatctactacccactcattactaaataaacctcactcaattaataattcaattataatatcaaaatcgtcataaacactactaaaacacgattaaattatagattactggaaatgacatttaaaattattcaagtacgaatcgaagtcccaattaaatttaggttgagccgcttatttaagaggacactttctttcaaaattgaattagaaattta

SEQ ID NO: 259 - DNA, 11926 bp, Solanum lycopersicum
atcgaaaaatgaactgttaatgacaaaaaaattcataaatcgaaaatcgatagaaaaatatattttagtgagttgttattgatttgacgtatttatttataaaaaaattgatatcgtatataacttattttaagaaattattttgagatatcttttgtgtgaatacatattagatgtatatgcatatcaacacaaacatatatatatcaaagtgcatacgttttagattataatttaatggtgtatacctgtaacaaaatgtatacatttcagattagaatttaaggttgtatacataatagaagtgtatacatatcgaaattgtacgtattgtagtataataatgtatacatatcaaaattgtactgaataaggtgtatacaagtttaatattaaagatacaataatttttaataaaatcgaataagtattttactactctaatataatctttaataaattatagtaacttttttattattattgtaatatgatgatttcttatatagtatcaacaaattatatatattacacatctttttcttccacttttggtactcatccattaaagtttctactattattaaattagtaaaagccaaataatcactctatattatgacataaatttgactgtgaacatgctagtaaacttcttatcgtataataatttatactagtcaagtaaaatgtaataagattaattgaaaagatgttgatagaagaaattaatttgtgatttttattatatgtatttcttttgttttgctattggtattttttgaatgctatcgaataaacttgatattatattattaaattcgattaaaaaacgttgagagatgaaatcgatttatggttttctttacgtgtgctactattactattagtatgtggtactatgatatgaacatctgtttcattctatacgagtcaccacaattacaaatgcatggttactagtactttttaaaattttatttatatataaattcaacctattctaacaaaattaaaaaaggaccctcacttcctcaccatttttaagaaagctctgaaaaacttttcatacaaagccaaatctatttctctctctttcttttggtcaggcttctacagaaaactctgttttcaacgtatatttatttattgtcatttgatttgggacagatgaggggtttacctgggcatgaacgccggtggacgtcggatacggtgtcttccgggaaggatttaagtggtgagtcatcgccgggaactgattccgggaatatttccggttttgcttcggaggagtttgttgaagttatacttgatcttcaggatgatgatacgattattttacggagcgttgaaccggctactgtaatcaacattgatggttctgatcctgcttccggagtcggtattggtggagcatcgattgaaactccggcgtcggtgacgtcgacgtcggaaactcgatcgccgatgatgcgtcggagtacatctaataagtttcgtcagttttcacaggagttgaaagctgaggctgttgcgaaagcgaagcatttctcgcaagagcttaaagcggagctaaggagattctcatggagccatggacatgcgtctcgtgctttttcgccggcgtcgtttttccaaaacgctgtcgtcggaacaggcaacggtgtagactcggctttagcggctcgagcattacgtcggcagcgtgctcagctcgaccggactcgttccagcgcacacaaggctcttcgtggactcaaattcatcagcaataacaaaactaacggatggaatgaagttgaaaacaatttcgctaagctcgctaaagacggttacctttatcgttccgatttcgcacaatgcatcggtcagtactcacgccggcgatcactacagtttaattatagattaattacattaattttgattaattatttggttaaaggtatgaaggattcaaaggaatttgcgttggaattgtttgatgctttaagtagaagaagaagattgaaggttgataagattagcaaagaggaattgtatgagtattggtctcaaatcaccgatcagagtttcgattctcggcttcagatcttcttcgacatgtacgcaccattaacttaattaattaattagtagtaatcagataagagttaattatcttaaagtaaaattagagaaaagtagttttagtaaacaaaacgtgaagagagagagaaaaatttactgtttgctttccatgtggaacactcatccactactgcatgacaactgacaataaaactaatcggaatatttaagtggcacgtcattatctctctaatagagtaattacttgtgcaaatggctcaatagtgcttacattttacagcacttaacaatccttgtggttttcattgtatggtacagggtggacaagaatgaagatggtcgaattggtgaagaagaagtaaaagaggtaaatattcagtatactattttttgctatattccctccctctgagtaaagtataagtgaatttctatgaatatacaacatttgtggctcacttgtggttgtttggtacgtaaatggtgagaaaaattatactatccttatagtataaatgattagataaataattttgaaataaatttttttatcaaatgtaagataaaataatcttacatttaatctcaagattattgttacttatatctcatttaaataatttcttatctttttaatttatttaaaaaaaatattatgtacctataattggaaaagataatttactcttttatccttaagaaaatgatgtatggcaacataaaggtgtttagattaaaattttcaaaagttctaatttattttttaaatttcgtattaattgtgactagcgaatgttattttttaaaaaaaataaaaaattaataacttaatatttttgttttaaaaatacgtattaagttagatagattagttttttttattttttatttttttgttccaaaagaataatatattgtggtcagattacgagaaatgaacttgcctaaatttcagtgttaaattttttaacggttaaagaaattatgagaaagaaggcaattgattgattaaccttaagttcaggattattttttcaaattaacatagcctttataaaataattttttcggagaacagtctgtcaggttgtggtttcattaaaatgtcccgctgactttgccttataaaaagcgtactgacttgcataaataattcattatgcatatacaaaacacatgcatttttaattaaaaacgatactacgaagtggttaggctttataatccctatttttctttgttttttttttgtgatgggataaaataatatgtgtttggcgtgatgattaggtagccagataagaaaattataagaatcaacgactccaaatataattataaatgtattttgttaatataaattcattgtataatctctctagtctgctgtctgacgctaaccatgttctagaaacttttttgtctggttcaaataatggaacgtcaatgtataaagctctttatgcaaataatccctacatttttgttttatcttttcacttacttaaaacatcgttttcattggagttggtgggggcgtttttgtcaagtaaacacatatcttttatatgttgtcaaacctttttctaattcaagtatattttgtttttaaaattatttattcttccctttttccttttaaaataaaatgtcttttggcccaattatgttcctgaaaaattattgaaaagacatttgatggattaaaactccatatttaaataagggtggacaagccaaatcttatttcttattattttttagtttgtgatataaattccaacaatatatattactatttgacaatctaattcttatttttttttgttaaataccaagtcaattctcctatctaattaaatttcatttggcatagattgaggtgatagataaactttattggaggataattgaaatagtttgaggtgataaaactttcttggaggataacttagagccattgacatattgcttatttttgttatactgactaaaagcaagtgtttaaaaatatttttataaaagtcattttagcttaaaaacatttaaaataggtcaatctatacatgttttaatctcctggatatgtatgaatttttttttaatttcatactttgtcgtaagaaacttttttcataagtaagacttgaattcaagatctctaattaaagatggatgaagtcaatactgcaacaatatttactagtaaaattagctttattatattgtaaacgacagacagataatatttgccttttaatatttagtgtgatgaataatgtagatcatcatgctaagtgcctctgcaaacaaattatcaagattaaaagaacaagcagaggagtatgcagctctgatcatggaagaattagatcctgaaagacttggctacattgaggtaggaccctctcacccttccccttttgttaaggggggtgcaaagtaacacaaattattttatttttgtttgcttgcacgtcaattcgtcttatcatgactaactcttcctataattaagtaaattactatcagttgattggttattgacttgtgcaaaatggttgcaactaatttattgcattagacttgcaagattatttaaagtccaagtttgttagacgacaaaggagtgacactgagaaaccgtgttgttcaacaaatatttttccatattataataccattgtcattctaattttctaaataaattgccaaattgtagtcgttcaacagtttctcttttcatttctttcctattttctgctggctcatctgctaaaaggaaaaaaaaagtgaaggtgaaatgaaatatgaaaagaattaggttactgaagttataaggaggtgatctgttcaaacttcaaagaaagacgctacctaatttttgttggttaagcttaccttatgtagttaagattaagattgagattagtttcaatattttaggaaagtgaaaaatgctgtcacatccttggtcagaagtttatgaatttttaccaattttatcatccttttttaaaattttataagtattactattattttttctttagtttgttaaaaaaaaaatctctttttatatttgataactctaaagttttagcctcctacttgatatgtctaataccaccataattaaagagcattttgaaagaaaaattagtgagacttttggtatttatattcgataactccatagttttagcctcctacttgatatgtttaataccaccataattaaggtgcattttgaaagaaaaattagtgagaattttggtatttatacgtacttaatttaagattatataatttaaaaatctttcttattttaaattttgttcttcatcaaactaagagaaacatgataatttaggggatgctctgcaataagattgatcacggaatatagtggaatgagaatgtgtgcactagtttatatactttattttatttatccacccaccccacccccactactttggcttctaaattcagtcatgtacctggagtaagacatagtgcaaaaactttaatttattgaaaaccatcacttaaaaagatatatgctactttccatctcttaaaaagatttataacctaaacatgcctactaccattttcaaaattttgaaaatgtcaagtgaagtattagttcaaacttcaaattggccacttggaattaatataacttaaatttaagcaggtgtagtagttttaataatgcacctacttttttctctatttattatataaatttccttttttccaaatttgagtgaatataatttatcaactaaattgatatttactctagactatacttgcattttaagtcttactagcacttgttttctgatttatcaaagtctatggttcctccatcattagaaggtggagaatatacgaccattacctttgttggcggtcctgacatcccatgtggaccttcccctttgtgcatcaaatgcgcgttttgagcactcaaacacgtgaacacaaaatgtctttcgccaacgcaagttttaaaaaagggaagaaataatagttgaaataaaattcgccaaaaatgatttataataatactaagtgattactacttcgttttcgattgtgttgggttttttaagttgttgatggaaatgtattggatcttccaagaatatttagaaaatttgatatgggatgaagtaatatttttggtgaatcgaggaacatatttattcgatagttatgtaagggaaggacagtaaaacagcaaatatgtgatgtagtagtccaggtgtgatcaatcgatccgaacacctcttgtcatgaaactaaaagtaaatttcataatcagtggaataaataatttgaaaaataagactaataacttgtaatgacttaaatttttttagattgagacccttttatggatgaataagcatattgtaacatttatccttgatttactgagcatgatgccatgacaataagtaacatgttgtgttttatcatgttgataatgcagctatggcagctggaaacacttctcctccaaaaggacacttacctcaactacagtcaagcactaagctacacaagccaagctttgagccaaaatctgcaagggttgaggaagagaagcccaataagaagaatgagcacaaaacttgtctattcactgcaagagaattggaagagaatttgggttctggtcttgtggattttgataatgattggactttttctttggaagttctatcagtacaaacagaaaagtgcatttcaagtcatgggttattgccttctaacagctaagggtgctgctgagactctcaagttcaacatggctttaatattgttgccagtatgcaggaacaccattacattcctcaggtctactaaattgagctgttttgtaccctttgatgacaacataaactttcacaaggtaggctgccccttttcattctcctttactaagaccactgataatttgtaagttgcaataggcaggtttatatttgctctaatattcttactgtgtgcagactgttgctgcagccattgtcactggtatcatactccatgccggtaatcaccttgtatgtgatttcccaaagcttatacatgcaaatagtacgaattatcagaaatatttggtgaatgattttggcccaagccagcctcagtacatagatcttgttaaaggagtggagggtgtgactggaatagttatggtaatcctcatggccattgctttcactcttgcaacgcgatggtttaggcggagcctcattaagttacccaaaccttttgatagactcactggtttcaatgcgttctggtactcgcaccaccttctcatcattgtctacatcgtactgatcatccatggcacattcctctaccttgtgcataactggtactccaaaacggtatagcttctgaattcttgtgctctccctttttaataatattgatgtaatttttattgttttcatgccattaacatgtatttgctctcagacatggatgtatatagcagttcctgtacttctttacgcaggggaaagaactcttagattcttccgatcaggcttatacagtgtccggcttctaaaagtaagcttctgaaattagcattttgtttcacttgcattagatttctggaatcagggggttctttatatgatctgattttaatgttggacatcctagctaattcacatggtgaaattcaatcacaaaatgaaaaaaaaaaacagaatagaaaacaataatagcaacgactacaccttaaacccaagctagttaggggatgcggattcatcatgcattactcctactaatattattctgaatgtcatcttactacaactctactccttgatctagacttggaatcgtccagatatgtgagctcacactttacacaggtagagttatacatagaaaatactagtaaacatttagtagctaaattcaacatactacaagtcgtagttagtagactaatgctttgtagctaaatttcacgaataacatttcccttactgcaaatgctgaatcaaacattttttttctcccattttattcatttattgaagttaaacaatttattgcaggtagcaatatatcctggaaatgtccttactctgcaaatgtctaagcctccgcaatttcgatacaagagtggacagtatatgtttgtccagtgtccagctgtttctccattcgagtggttagtgattcaaagcatttagattttagtgaacttcattaccctacagaacaaaaagttccaattttactagattacacgaccaccacagtttctcatttgcaccaatttagagttgtttgttttaccctgttctctctcttgaatagtgaaactagcactttgatggaagtgtagtatggtgataaaatatgtgaaccgagttcagaatgggaggcaggggaagggggatgcaaatcttagttatctccaatattgtcctaaacatttgataagacttaagtaataagtatgcttctttgctgagattctacatgctcaatatccaggcatccattttccattacttcagctcctggggatgactacttgagcattcatatccgacaacttggtgactggactcaagaactcaagcgagtgttttccgaggcttgcgagcagccagaggctggaaagagtggcctgctcagagctgacgaaaacaccaaaacaaggtataattctacaaggacttaaacttaaatggagattagtttccgtgtatatttaagaatcaaaagattccgggtaagtatatgagtaaacttggaggtattattattattaatgcaaagggttactcctgaatttcagtttgccaaagctattaatagatggaccttatggagctccagcacaagattaccggaagtatgatgtcttactgcttgttggtcttggcattggagcaactccctttataagtatcctgaaagacttgctcaaaaacatcgtcgcaatggaggagcaagcagtgagtttcttcatttgtcatgtcacagtgcatcttctgtcttattctgctttttgttgtcttctcgagatagcgtgatgaaatgtttattttctgttatcaggatttagtctcggatttcagtggaaactcggacatgagtgctgcaacaagtgaacaaccagctctcaacaagatttctccaaaaaagagaaagagtactctaaaaaccacaaatgcatatttttattgggtgacccgggagcaaggatcatttgattggttcaaaggtgttatgaatgaagtggctgaacttgatcaaagggtaatgcaaaatgcccagaatttcaagtaatttcctttctatctcaatatttatgatattcccatgatgttcagggtgtcatcgagatgcataactacttgacgagtgtttatgaggaaggggatgcacgttcagctctcattaccatggtccaggcacttaaccatgctaagaatggggttgatattgtatcaggcaccagtgtaagtaatttaacagcttgaagttatattttttaaactcaattcagtctttaggcagtaagttctttccttttagaccttactcattagcaaaagttaggatattattagacatgaaataactaatcgatgcctaacgttgcttcagctattgaatttctcgctgattactatttatcaacaggtgaggacacatttcgccaggccgaattggaggaaagtattttccaagaccttaaccaagcatgcaaatgcaagaataggtatgattatcatttgacgtgtccgacattgaaaattgtcattgttttatggctagttgattccaagtttggtgttttcgagcaggagttttctactgtggtgcacccatattagctaaagaactcagccaactctgcaaagagtttaaccaaaagggcacaacaaagttcgagtttcacaaagaacatttttagaagggcctggagtatgattaatcttgcatcaacggtacacacatctatcttcggtaccttatttgattattctactgaagagataacattagtaaggaataagtcagagataaattgtacataataggaagaagactatttcaagagaaaatacataccaataagatgtgtataggttttttatattcagtcatctgttatcacataccaaacttcagaactcctaaagggagactctgctttggtcagatgactttagaatatgggaggaaaaaaaagatgacaattgaatggtcatgatacacatgaaaaatgagaatattgggatacagctaataagaagttgaccttcttgataaagaaacactgaaaatggcaagcatgaaaggacagacactcattgcttgaatggggataacaaaatacaattttgaaagaagaagataatataagtaggactagtgggggactgatagctttgttggtggaacttataatggggctaagagaatccttccaaaaaatgtctatgtagtaactactttttcttcttcttttgcgttgtgattattttttggggtattttaatatactacttattagattagaggatagaaaatacgtgtatatgcaattcttattagtaaagtttatcagttatttaatctggagaaaggtactatcaaaggaaaaatctcattgattttgttgtatttccttcaagttttttctcaacgtcctatcaaaatctcacagattttttattgatagaaattatcatgtacaacttgtatgcgtttgagatataattgttatattagtgagtagcaagtcagttttattaagttagcaattactccattttttatcatacagtataagtgacatggttaagcatacatcttttacagaaggtgtcaaatatttatactatataaggtgagcttaaagatagttaaagacaattattcaaagtaaatagaattaacagctcaaatgatgctgcaaataactttatacaacatgttaaattgctcttatcttagtgtttagtagaagagtacatttgtcatggaagcccaatcttgatctacaagtttcgttgatcttgttgggcctctagtccaaatgctcacctagcagttgttccataagtaatccctttaaaatcatttgccaacctaggttttttttgtagtcactagtggtaccattttttttagcaacaattttttttttaaccacacaattagtcgtctctattcgattttcaccgcccctatccccccaaaaaaaggacctcctgtgggggtgagacattattttgagggaagttccaactagctaggagcctaagacaatggtcgagagagggaacagaaagggttcatgcaaatcattttctgtaacgaaaaattacaccgtatagtatatatatggacaatatatttcttatgcgttgtcgaatgttcattttacattttgtttctatactttatattttgaagctctatagtgaaattctttgacttcacctctctagttaggaattattagtttcttttgaacaagtaattaaactagttaaggtagataattgaggttttgaagctaattatattgacattttggtgcaaataattctggaatttagaaggaagttgggcaaaaaaaaaggacaagtcaagcctacggtttcattttggaagtcaaatttgtatactttttcatccaaattaatgttaaaccaatttgaggtttgttactaaaaagactaattgagaaccgcgtttaaatagtttttagttttagtatagtgatagattacccaaattctccgtttca

SEQ ID NO: 260 - DNA, 5312 bp, Solanum lycopersicum
tgttagatgagttttcacaacttgaacatagggaacaaacttgagtacccactggaatatgtagcctcatgtgataatccgccacattctaaagattcgtaaataagttatcaaatacaatatgatatacttagtagaagtctaagtccgtgacactaaaaagtctgtcctcggttaacaaccttctttgcatagcaaaccaaataataaagttgtgcttagattggggaggtgctcctcatataacctttttttatgcttatccttttaaattgttgagatatgacaagtattatgtaacgatagaaaacagtataaattcagatattatattcatcaaaataatacagtaaaataaaagtacgatgtaataatataacaaccatccatttgacaaggtgtaagtaggtagagagacatatataatcagatatcttaataacaatcattttctatagatttacctataaatagcctaatttctttaaatttcaattttcatataatattatattattctttataataacatttagttatcacaattaaaaagtatcagaagaaacgactatataatctaaaagtttgattgttagtagcttgaatagatggtactcaaaaactaaatttcatttaaaatgacttgaaacgaagttgacccaattaacacgaatcgtttaaaccaaaaaaaagcatgatagggctatgtcaagttgcccaatagaaacaaaatgaagaaaggtcattactcaatagaaaccatatctctttagtaacaaagataattgagtcacaaaaatatgagtgatggtcattaatctcacccataccccctttatatcaacctatctatacaaatatcatccacgtggcaacgtctcattaactacttatctaataccccacccccacccccatagaccccatgccccaaaaaagttagaggctaaaactaactcaactatagcaacaactttgagataaaaattttatatttgttcattgtttgatattttgccctctccattctcaaaattcttaattttaaacacacaaaatggagactggtgttacatgttgtgcaagagtaacatctcttctcccaaatgtttcatctcaacaatactcaacttcaattgcaacttcaagatccatttccccttcattcaactcaagggtatgtcttaattgatttccatttgatttttcttcatttttctatactaattaaataaatttaggacactatcataaatttcaaaaatatcttggatataatgaacttgtacatctaaacaaagcaagtatagatgagctataagcaacggtagagctatgagtcttgtcgcactataagaaaaatgtgaattacatggaatttttctaggaattagtatgcaaatgaaaatttgcaggaaaataagtttcatacgaattttcatactaatctccggtaaaattaccatttaattcaaagtttattgtggtctatggatttggcatagcctagtagctttgacttagaccttaatctacttattattatatgtataaataatttattaaggactctttccaaggacttagaattcataactttaaaattctgaattcgcttctgtctttttaagtatgacatgagattcttgcagagtttgaaatcaagctcattatttggggaatcattgcgcgttgcgcctaaatcatcactaaaggtgtctaggacaaaaaattcttctttggtgacaaaatgtgagattggtgatagcttggtaagtttgatcatgtttgttgactaatcttatttaatgtaattgttatacaagaaattaatgagaatgacttgttataattggtgtattttataggaagaatttctttcaaaatcaacctcagataaggggttaatcaggttaatgatgtgtatgggagaagcattgagaacaattgccttcaaagtcagaacagcttcttgtggaggaacagcttgtgtcaattcttttggtgatgaacagcttgctgtcgatatgcttgccgataagcttctctttgaggtacaaaactatacactggcggagccaggattttatttttcttataaaaaaaatgcatgtatacacattcgcaacgtgtgagcaaaaacaagtttttggaccacctttgatattatacttgatgtcaaggggattcaaccgtttaaatatgtactaaacgatttgtttttactttacttataaagtataatttatcgatgaagggatttcaatcaaatcacctttagtacatattgctccaccctatttgacaagaagaggcttatgcctattgctacttgataaactgattctctacaatgtgcgttactctctccgtttcaatttgtttgtcttattttcctttctactttttagtccgttttaaaagaagaacgtctcttctcttttttgacaactttgtacttctaacttttcacctgacatgtttaaaatcactggattaaaggggacattttggtacatttaacgtatttttagtttaaaatcacaatattcaaaaattttctttacttaaacttcgtgtcaggtcaaaaccagacaaacgaattgaaacagtggatgtaattcttatctaagtttgacaaaaacttgttcttttgattgttgatgtgtaggccttgacatattcacacttttgcaaatatgcttgttctgaggaagttcctgagctccaagacatggggggccctgctgaaggttagcagattatgtaattcggaacaacttacgacttgtttgattatacactagaattttttgaaaacgtcaactttttttttcaagtaaaatgcatgtctaaacaaaatgtcaactttgaaataccatttttcgactttttaacttcaagtactactttgaagaaacataatagtattgaagacactgatgagttctatttgtatcaaacaggaggatttagtgttgcttttgatccacttgatggttctagtattgtggacacgaactttacagttggaaccatctttggtgtatggcccggggataagttaaccgggatcacaggaagagagcaagttgcagcagctatgggaatatttggaccgcgaactacatacgttcttgctcttaaagatgttcccgggacccatgaattcctcctccttgacgaaggtttgacatacatcgatttgtaatagtttagacttttcttgctacgagttgtctcaatatcgatgcttgtttatgttcataggaaaatggcaacatgttaaggatacaacagaaatcggagaaggaaagatgttctcccctggaaatttaagagccacatttgacaatcctgattacgccaaggtttactatcatttctcgtatttttgtcttcaatttcttatatctgtactcgaatgtgtgtttgtacaaattgcatttcttactaaaatgaaattccgcgttctgactcttgattcttgataacagctgatcgaatactatgtgaaggagaaatacaccttgagatacaccggaggaatggtgcctgatgtaaaccaggtatgtgtcatctcttttctcattttttactcgttttgcaaatatgtgatcaggaggcagaggcagagtggtgcaacggggcgttgaacattatactaaatgattctttttacatatatatgtataagttgttgaattcccttctcgatttctgacagataattgtaaaggagaaaggtatattcacaaacgtgacatctccaacagctaaggcgaaacttagattgctgtttgaagtggcaccgttaggattcttgatcgaaaaagctggaggttacagcagcgatgggaaacaatccgtccttgataaggtgatcgttaatcttgatgaccggactcaagttgcttatggttccaagaatgagatcattcgatttgaagaaacactctacggttcatcaaggcttaaggctggtgcaccagttggtgctgctgtttgaggcttgagaatgcagcagccctctcgtaaatcgtaatgtttgtttgtgtttcttttcgcgctttctttctagagcatcgcgaaaatgctgttccatcaggttgtaaaagggagataggttaaagacaacaaggtcttgttaaagaaatgggaattggaacatttttttttgtatattgttgtttctattaactggtgttcaatatgctggatttcagatataaaaggttaaaaaaaagacaaataatttgtagtattatgtaagataaatttatgtattacaacttgtctgattattgcttcattactattctaatatataaagttcgatttcaatcataaagttgtttccacatgcctatatgttcgcggttttgtgcaccctagaaatcataaaattgtctccgtatgacgtataagttcttggtttcaatcataaagttgtctccccacgacctataaaagttcattgatttgtggggcgcgaaaatcataaaattgcctatgtgtgacgtataagttcacggtttcaatcataaagtcgtctctacataacctataagagttcacggtcttgtgagcatcggaaatcataaaattgtctttggtttcgagtttagactaaagaaagggtataatatcatcacgccagctaggggtcaatgacccacaaggtcacgattttgtgggcctcgaaaatcataaaattgtttctgtgtgacgtataagtttacggtttcgagtttagaataaaaaaggatatattataatcgcgccaggtagggatcggtggcctatatgttcaccgttttttggtcctaggaaatgataaagttttgtcggtgtgacgtataagctcacagatttttggtcttaaaagaaaaagttgtatatgaaccgcgccaggtaggggtcgaacctacgactttctgcttaggaaacagacgctctatccactgagctacaggcgcttgtggtgtatttgtttattgcatattgtaattaactactatataatttaaaatgaaaattagattttcatacagacgttgatatgaatatttctcgtttataatttagttaaatataatacactctccgtccattttaattgtcatatattattaactacactccttaaacataacaaataaaatgataattttattacattaactttagatattagaaatcaccggtattctaaatcaatatacatattttatgttttttttttataaattcggtctagagcgatttcattaaataattttgtgctaaaacacatgaattacatattgctc

SEQ ID NO: 261 - DNA, 15365 bp, Solanum lycopersicum
attttatcattttcacatattgtaattataagactatgatagcgtgcgatcgcatattcttaagtaattttggagagtttctacatgctcttcgttatataattttaaaaatatatttgatttaaaaaatataattatacctataatttctaaaaattattcaaattataatgaatatatttcgataaaattaatcttatttgatagcaattaacaacaacaataaaagataaaataaaaatgaaaagagcattacaataactacatattgaaatgactaattggttcaagataaattattacccattaaaacgttattctttttaatagagttggtcgtagataaatactaatcgtaattaatgaataatgaatgctttcataatatatgaaagtttaggataatgttaatttttttttgaatactaaaatttaacgcaatatatgatttttttctataacttaaaaaaataaggtatttattaagaaacgacaaataatatagctaaattcctaattaccaagtttttttcaaatattattgtgatcgaaatgcaaatatatattatatatatatactagaaaaacatgtataatatttatattatttatacattatttaataatattttcaacatatgtataatagtacatcctataaaatatatgacaatagtaagtataatttcataaaataagatctgaaaatttaatataattcaacaaaatgaggtattaaaaaagatataaaatatgtaatttttatttatttataaaaaaataaaatttaggcgataacaatattaaaaataaaaaaatataatgtacgcaaattttatgtaaaatgtatttattttttgagttggtgcgcatattgggggagaagtacggaggggggcgttagtaaataggcaaaataaagaaaagtaagagcaggatacggccacgtacacgtgagcacatagaataaaaacccggatttgttatcacaaattaaaccggatttaataaaccatatgatacgtccggaacttttggttagtagtaattcgaggatagcttcatgccggtttcggtcaagagaaatcgccaccacagcaattgtgaagaggtagacggagaaggcgaagaagaagaagaggagagagaaaatctgccgccgccgccatcaccaccgccgtcgtcgtcgtcgtcgttgcggtggagtctctttctaaaaccctcatagattcatctaatcgaggtactaaacacctccttaagcttatttgctagagaaatacaaatatatttttattttttctaatgaattgactttttcaaaacatgcatagtttttttttgtggaattctgatcgaagtattttgaggtttactgtgttttttttaaatgtcatttttatttagatcaatatttgtttggacattggatggattgattttgtgtggctgattaactggatagttcaactacggagtaaggtttgtttgaagttgtgtgtacgagcggaagagtgtaaagatggatttggttgctagctgcaaggtaattagatttaattctgtttttgttgttgttgaactgtttgttttatttttttggtgctaattgtgaacattgcttagagttgtttaattttcatatgttgtggcagctcgactctttgttggagcagtgaaatgcgtggatagttttagtgtgatatacgttgctgcttgttattaggattagtcaccgataaatagtaaaatatcagatgaacatacaaaacttggaaaaggaagattttagagactgtgaacatacatagtaaaagtaaacattgattctggcatttatgcgccccaaatgtgcctccattgccagtaactatatggttatgtggcgtggcgtgttagtcaaattgcacgttgcataatgttctaattctaaaatagaaattaagtagtactggttggtctagaaattcctgtttgtataggttctgctctggaagtgttttacagaccagcttttgtattgatagtgctgctgggaatccctgttgttcgcccatgaatatatgaaccatatgttttggagacaccaagacaaaacttttggtgaattggttggtttcgttggtgacaattaattgtatcttataggataaattggcatattttcggataaaggagctcaaagatgttctgaatcagcttggtctttcaaagcaggggaagaagcaggtttgaactttttccatgcatttttgggattgctggttgaaacacagcttccttgctttttgtttaatttactggctgatgcttttacctttcataccttgctacattatcactcctagagggaggcctgtaatattaatcgtattgttttccgtggttattgcagtttttatggcatgtcctcctctttatctacatgttgattaatttagggctctctgcacatgctgagtttagttagtcctccttgcctgttgttgataaaatgataaaatgatgttgccgttagagctgtctctttttgccttgaaataggagggcttttcttttccttttctctgactaacacattaattaataacttaattggccaaagcttctgcaaggaaataagtattttcaagtagtaacaaaagctgaaacaagcagcttctcctgaaagcaagtggttttggttttttaggaccagattacccaaattataagttcatctccaccaaagaaactagtgtagtaacttgcctttcgttattttacacttgaaagtacttcatgaaaatgttgtccaaacacgtatgactaacaaaagtactcctcacatgatttagccaaacaaaaaaccagtactgtctaagcatttttttgtaaaaccacttttagtaagaagtgcttctcaagtaagctgacgtttaaaacaattttggtaggaagtacttctcaataagctggtttctgcagtttatagattcatgattatgcataggctagttatgttcctgcacaacacatgttacatcgatatgttagtttgtgacacttgtatttggtattgcaggaccttgttgatcgcatattagctacactctctgatgaacgaggtgagctgctccatttcttgcttgaagaagctgttgggaaatgttagacgcgtctggtttgttggtggttttctttgtgtttcaccattctctgttttcatttacttttttttttttttttataaaatatgccaatcttgtgctggagttgctaaagatacagagtcattcctcttggatattcttttttcaatttgatgtaacgggtttcctcactattcaatcttgactaatgtatcctcagtccatcacataaaaaatcttacccatttttcataattagatcttcgcactgtcttggtggacattgtgtgataacaacaacagtatacctgttatcccacaagtgtggtttggggagggtaggatgtatgtagaccttactcctacttttgtggggggtgttatgatagtgaaatgcttaaaaactgaagcattcatgtacttgttaattgtgggtatcttgtactgtgtgtgtgtatatatatatatacatgacatgaaaaaaataaatatatatgtatcttgctcttagctagaagatgtgtttgaacacacagccaaaattgatgaccgattctcacatatttcttcgctgctgaacagcttcaggattgttcccaaagagaaacagtgttgggaaggaagacgttgcaaaacttgttgatgacatttacaggtataaagcagtttcaatctcaggacacacttatctaaaagggggaaaatggactttgatgtttaagacccctatccaattattcagtctgttggacatgttcgtcaacaataattccttttaagcttaagatttgagtgcagaaggaagattttttgcctcttaattggtactcgaagaaattcttcatttttgtgtatagtgatgagtgatctttcttcataacaataacatacccaacaggcacagtgtaccacaagtggagtttggaagggtggatgtatgctgatgaccatactcctacctctgtgtggtggttgggatggggtgtagagaggctatgtcctataaagcagggtttcaagaaaaatatgacaacagaatagcaagatacaaagcaaatacaacaacaaatagtaatagtgtaatgcacaatgaagagtaagagactatgcaactactatatactactagtaatgagaagaggagaggaagaagctaaccccctacctctcccacattaagtgcgacaacactttggtatctactaacttcctaccttaagcaattacttccaatgcatattgatctttctacgtctgccagaaaaatgcaggtgtctggggcgacgggggcaactggggcaactgacctagcatcaaagtcgcaagttgtctccgataccagtaatgtgaagttgaaggaggagattgaagacacttaccacatgaaaattcgctgtgtgtgtacaagctcattacaaactgaaacaatgattcaggttttacctctgcactgattgcccttatatcttctactcgtttttatgaacatgcatcttcttttttgcgtacaaatatgcacatcttcagtgtattattttgagtgtgcaaacatccttttgagctctgattctctttcaaaagatataccaaatctgcttatgtactggaaagctgcgtaattacttataatatttcccagttggaccggtacaccattgcatctttaacatggtagactatcatgcttatctgttaattgcatgtgtgttgtcatcatgatgaagctgtgatctcagcgtaaagtatgcgtttttgaaaaataaattctgccacgatgagggatgtgctggacatagtgtcagcttgaacatttgaagcttctgtttcttgtacttgatgtattacatttgtgtctcatgatgttatcatgcttgcagtgtgaagacagaagatgtcacacatggcaacatattcgttgtgttgtcataccagagaagccaatggagggtggtgatccaccaattccgcctactactttttactgtgaagtgtgcagactggttcgtgctgacccgtaagtgttacctttggtgttcaattcacttttatcggttccttttactggagggattgtatgatttggctgcatatccatttactggagtgttgcattgtacttgtggctatgaaggatttttcttgtcaaataaattgtgttctcgaaatgtcttagatatcaaatacatactacagttctcttcaactcataaaaggtgtctcctgacattgctattatttaaaatctttgatatcttaagaagaacaatttgacatcaaggctgcaattgattgcttttcccctctgagatgagccaatgtattggagataagagaagtgggctgactctccttatattatgtagaaaccaaaggctgtgatgggttataggggtgatattgttccatctgtaaacaatgacgcgatcttagtagttgagaaagttgttagcattagctgatttgagaaccttaactgatgcaacttttatgttattttatgcaattgctctgaaatctcatttgggtaaaaacattttgccttgtattgaaattttcacattcatagcatgtgaagtttataacttgttacccataagctcgctaaacgtgtgagtgctaacctgggattttcagttcatggcggtaagacctgacacttcatttaccatgaatatggatacttaaatgaccactttgatgtggctttactttgttacatacatgatttatatggtactgcttgtttcaccttccataactgaattccctatatgcagcttctgggtgacaatgggacaccctttgtatcctgcaaagttggctattacaagcgttcctgccgatgggttagttacctgcaacttcgtttttgatgtctatcctgttctttattattgctgcacctctttttgcttggcttaatttgtttatgcggttaattctgtgaagatttgggacatgcagtttctaatacttgttcttgctactattaattgggagagatttttgtttgtgtttctctgaaacgatgttaaaggatgacctttcctttccacaaagtgattggtgcatttccatattatcctcaatattccatggggatgagtgtggtgggatggaagccaaaaaagaaatgaaaaaaaaaggaaggcaacttttctataacctacttttgattcaagagcaagtcattaggtggttagtgaatttcgaaaagtgatgaaaaagactccaaacactagtttgtcttgtatcttgggcatgcaagattttagtgtttaagtgcaagtcttggatctgtttgcatctgtatttgtatgttttcccctaggtcggaagtttgtgcaattcaaggtgatgaaatcatgtcatagcttgaccatattaagttagcttcatcatttatgtgagaacaggttagcagtttgaacttccagttgcatgcaagatagattgctcttcttaaatgtatgattttgcatttctttgttgtctgttcgatgatagagtttttggtgtgtgacatgagtaagccttttctgtctttgtggcaaatggtcccatgaatgtaagagccaggattctcagatatttgttgttaagaggatttatgcttctattttcctcactgaattacttgctctatcatccacaaggcatgttctgctttgttattgttctgtatttgtagctaaacaagtatgtaatttctttcctaatttacttatttcatctgtgaattttcaggacgaaccctgtgcagagtatcgagaaaacatttcagatcactagagctgacagagacttgttggcgaaacaggaatatgatctccaggttgttggttttcctggtgatggtttaagataaagaagtccttttatattcattgtgttcgttcttcaaacttgtcaggcttggtgcatgcttctcaacgacaaggtacaatttagaatgcagtggcctcaatatgcagatttgcaggtgaatggtatgctctgtcctatgttgcttcgtttttaatcctgatccaattgaaagtgaatgcttaagttatgttcttcttaatagctttcttctttcatggaaaaatataatgtcttgtgttttctttcaagttcgtagtttcttggccttaataagaactcggaggggtgaggtaaacatgatattgtgttctggggttcttcttaccattcttaactgaaaatattgtctactcaacttttccccatgtattcttctgcaaagactcaattgccataaatcaagtgaagattgcatttacaattttttttggttctagaagatctttcccttgtgcattaacttcagttgaatctcaaccaacaggggttccagtgcgcgcgataaatagacctggctctcaattgctgggtgctaatggtcgagatgatggccctatagtgagtattaattacatgcacttctgtttctgcctcttggaaagtgaattgttgtgtgtgtatttgggtatgtgcacttccactttggtgtatatttatcttcaagtgttgtgtaggcatgctgaaatttaataagtagcaaatcttattgttccatatgaactccagataaatgtgtgaagtgtaatgcaagtttacacaattgattggtcaaattggtctcagaaaagtgtttgggataaatcattcagcgttctttttttctttcaggaacattttatagatattttatagatatttctctcaattcgcaccttacctttttatcagatcacaccatgcaccagagatggaatcaacaaggtcacattaacaggatgtgatgctcgtgtcttttgcttgggggtcagacttgtgaagcggcgaactgttcagcaggtagttaagtttgaccaacattatgcattatgtagattctcttgcaaaaaccttttttacctgttgttttttagtattcagttgaagtcttactttgttaattagtcgattattatttcgcttagagcacactagtcagatgtcaaagatatttacaatgtatgaatatagctcaaccaccacgctcatctatcaagcaagtccaacaaccgatataaaaggcattttcccttgcaccacaaatataaatgaaaggaaaagactgtcttattacattttaccccccaaattatcccaaggagagcttgatcttagcctaaaggccgagaaatttattttctattgagaattttgtcttaaaattatccaaaggaggcacagctgcattgctcttcatgtgcctttgttttacttcgatctactcgctgtcacctgctgataatacttcctcctgctgttaattgcctcaagaggctgagatactaaccaattgatattatatggcgagagcacaagtgtccagaagttgaggcaaatttgtaataaataaggacacaatttatgttttccccatcctgtgcctggatagtaccatctcacaacaatccgcttcttctttcaaaatatgtttggtgagtacttacatttcaagcttcacattatatattaagaaaacaacttttggcggtaccttcacgtttcataacatctttactattgtataatttctcctcaaaatgattctatttcccaattcccacccactgtatcatgcgatcttctgcctctccctctactaagcattcatacatcagctgtaggagcttgtataccttgtcatgttctgatcttggatggctccatgaagtttatatcccactagaccccatttttattcttacccagataatcagttcattatcatttgtcaaaccaaaaacatgtagagatgctattttcaaagtcgtgtgccccacactacatgtgaacataaagaaaaaacatcgtttttgacaatgtagctgcggaaacctatgaatttgtaactctttttttccacaacattacatcaataatcctttacatgtgagaatatctattgattcatgtcccatttaaagtggttatcgcccttctcatagtgcattctcatggataactccagatccacttctttagtattgcatcattataggagggctactgtagacttttgtaaacctctttgataggtgaatttttttctttttgtcgaataatattccatttttaacaaaggaaaaaatatcatttcagttccctctccgttccttcacaggaaaaatcattctctattttctattgctattgttgatggcatatacaaatatggacatgtaccttgatatgcttgaatgaatggatttcaatggtattatctttgtcttggaaaatatagtgtcttccaacaagctcccagggtgtggccaatgaagtgggttgagaaccatgagggttcaactttaaatcccagcaagagaccgaaaaacactaggtgatgtcttcccatatgttcctgccttggtggaagataccggtatctgttgctggtgggaggtggaatgtgtctcgtggaactagtcgaggtgcatgtaagctgacccagataccatggttaacttgtagatggtgtgtccattttcgaatacaaaaacttgccaattttggatttcttgtagcttccccattagtacaaattctgttttgtgtatattgatatttcaaaccactagtatttttgagagtaccaaggtcaacccaaaacttttcatgaaactaaagaggaacagatacagactagtggagacaattccttttctcctcattcaaaggaggcataaagggagttattctgaattataataatttagctgatgatttgcaatatctagccagacctctactttttcctgaatccatttgtctctagcatagaaatttggaaccaattgaatgatgtatgcttccttagtgtcctacttgcacagcacacctgtgtccatttccttaaaaggcacatgcattatcaatatcataaaatattcagtaattctcccagaagaagtccattctgcaatgtttctcccagaattacattctgaaatgatgatacatggtgtccatcactagtactaatcttttatctaagacattgattagtactctatgagctatctcctcagctgccttttgagctcctccatacacagttccttcctcctctgatctccttatccaagtttatgaagtatttttgttttgttgctgaccaattttccctcatcttccttgtttcacttatttaaatcatttcttaaaacactcgtgctccaatacaatctctgcacattcttcacaaccttcggactgtgatatgatacaggtaccaaaatctttttctgtaaggtaatggaaaatctgtctgcccattcactggatggtaaggttttctttacaggacatgattctgtctgattatagagaattaagcaattaatcattttcttgatttcaagattatactgatgcctatagtagctgttagcattaatcaatctatttctgtttttaagaagtgtgctggtgctgctcgagatccctgtcagtcccttccaactgtggccttgatatttctgatattgttcttctccccaaaaataatattcacgatattgttgtaaaaatataaaaattcctgatagcttaccatttacatcaccatagacttgttaacaaacaagggatcttagatcttatctatggactgtttcatgtttatgatatacctttgttttattgttaggttcttagtatgataccgaaggtgtcagatggtgagaaatttgaagatgcccttgctcgcgttcgtcgctgtgttggtggtgggacagccacggaaaatgctgatagtgatagtgatctggaagttgttgctgattgtattcctgtcaatcttcgctgccctgtaagtgcatactgaagttataatcctgtttacagcatatctattagttagtgttgtttggtttatcgttgtgttatctctcggtgtatttgttactgtgtctcttcctcacttagtgggctttttggtttgttcaaagtaagacaatcaagctgcaagctagtgtaattgcatacaatgtggtcgtagctgttatcctagaggtcatatgcttcagattcaagaacctccattaggcacaatcttagtcatagatgcgattcaagtgtttatttggtggtttgaacaagaaaccacaggatcaaccttttgggcatatcacctgatcaagataacatggtggagcactggcttcccttttattcttccatctatactagtgtccaccacgtctcttgctattattatatgtattaatttttctggaggaggatagcatgtccgcgttcaaataatttggattctaattggattttgtcctctatattgctttgttgccttttgtgtattgctgtgtaatgcagcacaagtctcagggttcaattttcttttctatgtgcataccagatgagtggttcaaggatgaaaattgctggaagattcaaaccttgtatacacatgggctgctttgatcttgacgtctttgttgaaatgaatcaaaggtcgaggaaggcaagcaactataacccatatctgaactaatgtctcaagttcccatcgtatatccatcggatatcatttattgacaaatcttgttcatgtgatgcagtggcaatgccctatctgtcttaagaactactctttggagcatgttatcatagatccatatttcaatcgaattacttctcaggtattgcttggttatttttggggatagtaactttgttttagcatttagctgaacttttgtgcggtttcacgatgtagatgcgtagttgtggagaagatgtcacagaaatcgaagtgaaacctgatggttcttggcgcgcgaagacagaatctgatcgaaggagtcttggagatcttggacgttggcatttacctgatgggtctctgagtgaatctccagatatagagtcgaagcctaagcctgaaattcttaagcaggttaaacaggaaggaggctctgatggaaatggccttaaagttggattgaagaagaacagggacggattgtgggaaatcagcaaacctgaagaccagacattttcatctggaaatagattgagagaaaattttggtcaggatgtcattccaatgagcagcagtgccactggaagtggcaaagaaggtgaagatcgcagtgttaatcaggatggtaatgggaaccttgaattctcgaacaatgcatttgatcttgaggccatctctcttaatattgacccaccatatggttttggcaacggaaatccgtcaataccagcaggagatgctgaagttattgtactaagtgattctgatgaagagaatgagccaattatcccatctggagctgtctttaataacaaccatagtgatgcacctgtagtttcttttccagctcaaccactaggaattccggattcttttcatgattctgcgcttgttaacggtgggaattcatgcctggggctgttcaattctaatgacgatgaatttgggatgaacttgtggtctttgccttctggaacccaaggtggccctggttttcagttatttagttctgatgctgatgtttcaggatctttagtagatgtgcaacatgaatctattaactgtaccagttctatgagtgggtacgggttgggtgcagagagtggcattggatctgcttctcttcttcctgaaacatacaccgatcgccctaatgctgatataaatgatagtttagttgataatccccttggatttagtggcaatgatccctcacttcaaatatttcttcctactagaccatcaattacgtcagtcgaggctgcgagggatcagcctgatgtttcaaatggcgttggtactgaggattggatctcacttaggcttggtggtgatggaggggttcctggtgatactgcagttgcaaatgggttaagctctgggcagcaagtacaaactaaagacactgcgttggactcattggctgacactggtatttcctgttgttctttaccttttttttttcctttttggaggggtgggggtgtgaggagagcatggataaatgatccacgcttgcttgaattagcattgtgagttttgcacttttgccgcaaaataaaaaagaattggtaaaaaaaaaactagttaggtgattattattgtttagatgtacaacaggtttagttgagaaactgcagtacaagcacaattcacagagtattgcagtgttgttcttttagagatggtttacttttcctggtagatattcttatgagagctaagatttgttgtcagaagttctgttttgattcatgtattggagccattctaaatgtaggtagtgatgctcctgtctgtgcagcttcattgcttattggtatgaatgacagcagatcaactaagagcagtagagaacgatcagatagtccttttacatttcctcgtcaacgtcgttctgtaagaccaagattgtatctaagtattgattcggattctgaataggagcagattccatggtggcagaacaatgattactgttgctaagcaaagacattggatatgacgagatgaggttgctagtgaacacaaattggtcaacaagaaactatcttctcacatctgtgctggcgacgtaggagttttcttagtggtatgtgctccaacctgcaaatatgtcatgtcatgctcccaattccctggcgtcctcacctcactttcttttccattgcaaacaggaccaatcttattttttttctcttccgtttccggatggaatacttggaaggtgactcgctggtgaactgtaaattttggacagcttagctcaggacaagatcttctagtaacgtccactggtaaatccggagggggaggcattttagcgctttgagatctcctcttgccatttgtgaagccagtagcctgtaaatcggtttaattaaactaacttacaaaaatgtataatgttttgaatgtgtttaaccgttaatggaccttttaaggtcgggctcaatatcctgataattttggtgcgaaggaaggtggtaaaaggaatagtgatagactctttgatttcggttctttatttttagttgatgcatttagaataggtaaggattgtggaacccgtgataagagcttgttctatgataatgtcctgtaggtggcggggtattttgcgtaacccttgtttgtctcagttgtctataattgctactacaagtttttcctttatgcctgtgttaatttatagaaactggcgtgtagtaaatttatcaaacatagtctattgatcatattttaagaagtttgactgatatacatgagaaaatgaaaataatcttgaattcttgttttatgatggagaaacttgaaaaacatagtaataaagtttgtcttgtagaaataatgagttattttcactagattgttcaaaataaggtcaaatcaagttagcaggtcataatccttcgtggccttaaaactctaaatagaaaagtggcaatgatctagtatttttcactgggttgaatatttagcatctaacgaagctgggatatctatgtttgcctgttttgggttggtgtaaacttgacaaggtcttgacaaacgtccacaaaaaaatttggcatttttgacgtcggaatttggataacccaaaaaattgtttgctatagcacacaaaaatcgttgaaatgggggtatgcgcatttcgaggctcgtttgaccttagaaatgagttggattggccgtaatggccaactggctgcatagacaaggtattgacggacatctacaaaattttttggagtttttgacgtcttaattcggatcacccaaaaaaaagtttgctatagcacacgaaaatcgtcgaaatgaggggtatactcgcttcggagctcatttgaccttcaaaattggtcggacttgccgtgagggccaaccggctgcatagacagggttttgatggacgtccacaaaaaaatttggcatttttgacgttggaattccgataccccaaaaaaggatttgctatatcacacgaaatcgtcgaaatagggggtatgcgcgcttcaaggctcgtttgaccttgaaaattggtcggactggccgtgatggccaactggctgcatagccaagcttgacgcacgtccacaaaaaagtttggcatttttgacgttggaattcggatcaccctaaaaatagtttgttatagcacacgaaaatcgtcg

SEQ ID NO: 262 - DNA, 4734 bp, Solanum lycopersicum
tttaataatttattaattttataataaatgatgatatttgagcaattatgaattttaataaagaagaaagtattttgtgcataagcaatatatgtaaaagctagttgaaatgaatttaatagttcgaatatttgaaaaaaagatgtattaatgtcctagcaaaaatgtgtgacttttgagcgattcactatgacggagtgaacaaaagaagtagaggtagattgaaaaagtattaaaactatgtgattaaataagatatgattcacgtgcgacttactatggacatgatcataaattaaaaaaaaatggagatcaagaattaaaataaaaggtcaagttaggtagtttgagtgttgtacaattctctaatcgattactcttctattaccacattctttgattttaatatacttgtattttctttacttcattttatatcgtagtatttgttgttgctattattttcgttttcttgttttcaatatgactcttcattaccgtatttgctttctatacttaatttttgactaaaatgagattcttttaaaaataatatctctatcttcaagataaaagtaagactatttatacactaaatatattattattatcgtaaataaaaattatatacaaaatatagatattattattaaaatcatgttattaaaataaattgtaaacataatagtatcaaagactctccaactatttcatggcatctctacctttttctgaacggaccaaaaagtacaatttctcatattaaaaaattaaactagtgaccaggagtatacttttcttttttataaatctttatttaatttaaacaatagaaaattattataattcgaataacaacgaaaaattgttttagaaaaaaataaaaaaacgaaaaattaatatgtaggaccccaccattaaaaacttgtggctgaaaaaattagtgggtgggtgacgtggcaccatgtttaaattaaacgatatctaaatcactttcagtagaacgccaacagggtttgcttctaaaaccgtatctctcgtagaaaaaaaaatccacttttgaaacgtcgtcaactcgccggcggcgacttcgtcggatactaaacgagaatccccagaataatagagtgtttctacagtttcccttttcgtttttttgaatacccttttcgttttagtctggaaaatgacttgtgattcagagatcaagctgtttggcaagatactcccggtggtcgtctccggcgttggtaggggtttgtctggtagtgatggtgttatatatgatggaaatagaaatgggtctgatcttgatcgatgtttagagggaagtaaagcaagcagtgtagagaaggatgaaggaagtgagtatgaaaagcaagaagctgaaaaggtacttctttatgtaatttctatggaattaaagtgagagccaaatgatttaatcgtttaattttaatgggtttagtaatttggttctaattacttagatttaacagatgaaatgattcaattttcctgttgtctaattggtgattttgctgcttctttttgcttattgttgatgaatttttaatgtgtttctatgtgaagtagtttaattgagaaaccccaccaaccatattaaccatatgaagtttctagatctggtactgcttaatgttcttttggtgccctcttctttttagggattattgattaatttgaggattcaaagcaccaaaattgatatttcagcatcataaaagttatgcatttaatgtttcctttaccatataatttgtagccaaaacattggaaaaagaatgtgcttttgtctactttttcatgtatatcacagttgaagagggattctcgatctgtaataaagtttcgaacttgtcagtttactgtctgtgattggttcttgctattttgctgattggatttagctcacacagtttactgttgatatttaattgcaatttcataagcagcttatgcagttctgtgttttgattgtaggataatataactggagagctcagtgaagctaaatctgaggagggagaccaaaatcagatgatagaagaatcagaaaatcctaagactccatcagaatcagagagcagtcctaaatcttcaactgaggaagaccctcaagcagtaaaatcatccaagactgagaatgaaccgactaatgtgacaaattccgagcagaacaatctgaagaagccagacaaaatcctcccatgccctcgttgcaatagtttggatacaaaattctgttactataataacaacaatgtcaaccagcctcgtcatttctgcaggagctgccagaggtattggactgccggtggtaccatgaggaatctccctgtgggagctggtcgtcgcaagaacaagaatcttgcatctcaatatcgtaatataagtatccctgaaggattactagcagcaggaattgaatctccaaatgggttaattcatcatccattattcaaaccaaatggcactattctatcgtttggtcccgacttacccctgtgtgaacctatggcttctgcattaaatcaagcagagaaaagggtatcaactggtattcaaaacggttctcataaatcagaagtcaagaattcttcttgcaaaggtggagattctggggatgagtgctgtagagggattaacatcccgactccaaatatgatggtggaagaaggtaaaggagagccccacaaggctgttatgcatagtataaatggcatcccgtctcctgttccgtgcctccatggagtaccttggccttttccatggaatgctgcagttcctgtgtcggctatttgccccattcccttccctatgccattcttccctacaccttattggaattgcagtgtgcctccttggagtaatccttggttgagtccacctctgcgagctgcaaacgagaaaacatcaggttctgatcctacttcttctttagggaaacattcaagagagggggatttgcttaagccaagcaatcctgggggcaaagaacaatcagaacaaaagtattcagaggggtctattttggtcccaaaaacattgcggattgatgatcctgatgaagctgctaagagttctatatggtcaacacttgggattaaatatgattctactaacaggggagagtttttcaaggccttgcaaccaaaaagcaatgacaagcacaacaaagccaatacatttccagtattgcatactaaccctgcagccttatctagatctatcaccttccaacaaggtgcctaaagatgatcctatgaatctgcgaaggatggtcttcacttgaaattaagtatgactgttgtctgatgagggctttttggggcctagcaaccaaaaagtaacaaagctaagataatgcttttttctcccattgaactccagcgggaaacttcatggatttcctgcctgatggggacatttacagtgcgcagatcacttacagagctgccaggctaatatctctcaagtgatccaatgaaactggggaatgacatgggaagctattgtagaaacctattgtttatagttttcttggtaacaataagagcaagtggctggcttggtttttacttttgtgtgttttctaatgtacatacctttttacagctaacactagagtgaggaagacagttgtttagatcctcatccaacagttgttgtaacatattttaaattaatgtcaaagttagtttggagagccacttccttttagtacctctttttcttaatgataattctttacaaggacttaaagaatctaacactaaatcaacagaaacacttgttctctattctgtagaacaacatgaactgtttactctttgtttcatttttggtgcttacagaattttgtaaatgattctgacgcagtgatagtcaatacatgcagattatagttttcatcttctaaggaatctacaaaaagtagaaagataatatctttgctgcttctttttttcccttttccaaaccccccaaagccaatgagaagtggccagcaaaaacttcaacttttttaacttatttttctctattatctggattatgaaaatgttaaaaactgcacttcaatcccgaattaatttggataagcaaataacaacaaaatcgaaggatgtgatgaaacggatatctatgcttcatcagaagtcttgactttgagtcacatgaataatttttatttttgatagataacattctcttctatacaatgaatgaagagaacagagtgtacgcaaacaaatacctaactagactttttattagtagcaatttatccgtacaaaacaaaatagatatttttaatggggccaggcaactctaagccacatcttttgattaaattagttgggtttgggtcccaaattccatatgctcataatgattttaaggcattttcaattaactttttcttttcttttagatttttttcctttcccttttagaggcatttattttatataaaatgtctgatgtaatatatctgcatgttctttgtttttctgtttcttagacaactgataatccaaggttgaagatttttcatggtagggtttatcaattttaagccattcctttttttcccctaaaaataatatctatttatggattttacagctcattttattgtccattaatttgacgtagggcggctcaaaaatttcgatacttgttaaaaataaatgggaggcctaaattttt

SEQ ID NO: 263 - DNA, 7048 bp, Solanum lycopersicum
aagatcatgaagcatctaatagagttcaacttgtttgacatgcaaacataaagaaaaaagtcatgctataaaatagatagaattattcgtgttaaatttgtgcactcatattttgttattgatataattttaaaattttgattcgttttcgcatgtcatgtagaaagtgagctatatataagcaatttctaaggtagaaaatgtatttgtacttgctccctttttatagtttattttgctatatatagctagcgtttgactatagattttcaaatatttttggcatatattattgggtgaaaattgatcatgtctttggtcataaatatttgaaaaatgtatttcactttttaataaatataatttatatccataagttttaaaatttatcatagatttgtattagattgcaagatagaaacgtcgacgtaaaaagattcatgacttccgcaacaagtcaactggatcttcattgcatcaaatagcaagtaatgttcatgacattggagcaatgtgatagtttaaagtgagtgcaacaagtatcattctatacaccgtgaagtagacaaaacacatgactttattaccctaaatcaattgttttcattttcatcaacaaccatatcaacactttcatatttattcagtatttcctttgatgttcacctaaaaaattgtacaatacaacacaaacaaatactataataagtgttttataaaagataaaaatttactataaatttttaaaaaaatttaaatattgaaatttaacccaaagtattaattttttaatattaaattatatggacaaacattactaaccaaattttcctcaaaactttatttggaaaattgatggccaaatggatccataataactagagtttatataataataaatataataaattataatatattccttgacccaacaaaaaaaataaaaaaagtaatccaaacaaggtgtaagggggttcttatataaagttggggagtctaccaatgagacgaactcattgaccaaaatacgtgtgcaagagagagaccaccggagcaccaaacgccacccaacaaccacccattcaattcttctagaaaagaacatcttcctcaaaattatcgatgaaggatcgctcctcagtaattgttcgttgatcctacaaattcaatcacggctcttcttgaatctttcgtttgtattctcacaattcatcatcaccgcaaagtgttgacccttaatccaactcttctggtggacgataagcaccggaccccttcccctcacggaggtaggggtgcctcacccgctgaaggcggttgcccctccgatctcctcttcctcgccggcggcggtccaattcttcctttctctttttccttctcctaatttttcgtataagagttgtatttttgattatccatccaagaacaggaccgatgttgactgtaaagagggtgcctacactggtttccaactatcaagaggatgttctcgaaggtaacgtcatgggttgtggccgcaagtgcctcggaaaatgctgcatgcctggtttgtgttcgattctttaaatctttatctttcggaatgtataattttctgaatgctttttgcccctgtttctatatgtctggtgattgattattaggagtaacaattgttcacagattattttagagttgagcaaacaatgcaaggaaagaattacagttgtaattattatgtagattcagcttttgccagtgctattgcctcttaaagatcatgggttccattttaagatttttagggttaatctttggtattttaatgtgtatgggttcatatctgctattttagtaaatttctgacaataaattatgttccacatcgaaagttatgggttcaattgaacccgtatgtgcaatgctagatacacctataatagcatgaacatctatataactatagatgaatttacactcactgaaaatggtaaacctgtagtttactatttgtagtgttaatgttgcttagagttgatataatctagtggagtatcttaggttcgttgataatatgcggcaaaatatccactttgcatgcaccttaatgcagaaataagcaaactgcatgtattttccggtgaagccaaaagtgggtcgcgtgcctttaatgattttgtttattatagatctatgtggcttctgtttcgtagtggatacatcttggtaagtcagatgtgttaagaatgaggtttgggttgtagattcattattttgttgcttgatttcagtttcagtacttcctctatatgcattcaagaatgatgataatgagccaattgaaaatgatgttcaaaccttgcctgaggaggagtgtcagatgtcattcttgaacgatttgttgttgggcttatgggaggagcggatgagccagggactatttcgatatgatgtgacaacctgtgagacgaaggtcattcctgggagatgtggttttattgcgcaactgaatgaggggcgccacctaaagaagcgcccaacagagttttgcattgataaggttcttcagccttttgacgagaacaaattcaactttaccaaagtgggccaggaagaagtgcttttcaggtttgaaccaagtaccgactacaaggcccattacttttccggcatgcgagtaaacagtggtatttcacctagtattgttgctatcaatgtaaggaaattgtactctggtgctcttcttatagttattatcagatgcatcatggcttatggatcttgttttttaggtgagcccaattgagtatgggcacgttcttttgatacctcgagttcttgattgcttacctcagagaattgatcgtgatagttttgcaattgctctccattttgccagagaagtggcagatcctttctttagggtaggttataacagtttgggcgcttttgctaccattaaccacctccacttccaggtaatggatcaagcgaataatttctgattatttgattagcatgacttaactatatatatgatgttctcttgttgacattcacgacaggcgtattacttgtcagtgccatttccagttgagaaagcaccaatacagaaaatactggcaaggaaggggctgggtggtgctggagtgattgtatctaagttattaaattaccccgtacgaggttttgcttttgagggaggaaatggaagtactgcccgtgatttgtctgatgctgttgtgaattcctgcatttcccttcagaataaaaacatccctttcaacattctcattgctcagtgtggaaagaagatttttctgcttccccaggtaaatagcttgtccaactttgtgtactgttgctacaacactagcaaaagtttctcttaggtttatcagtacagtcatggaatttgtcatatcctgctgtttagaagctttaacgaatacttgttagatttttcgagaaatgcataaatatattttaagacacaactggagaatctctagttaatcagctagtacctgctgattgcaaagctgtgcacatttgtaagaagtgaattttacttgatggatttctatgggccagggattggaaataggatattgttgggaaaaagttggagatgaaattataatgaatgctggaaggggttatactctggagattgttaatgatacttgacaggtttgtcgtaggattgatgtaactttattgcccgttggttcctcaattggttgggcatttttagttggtggggatagtgatggaaaacgggcagattggatttggacgtgagcagattgaaagattgattaggtaaaatattcttagcccactttaatctcctaaagctagaaaactttaaaaaccttttatgactacattttttatccaaatggttgtaaatgaagttatatataccctagagacattgagtagtgaattactaataatgttattagtatataaatacaattatcttttctaccaaaaaattgtagattgaattatttgtcaaaacaacaggagaagactacaaattaatccaaaggcaaaaggagaaaaggaaaacaagtcatacaggatgtccacacgtgatgcaatatcaatatgtggaagaaaccctaaatgtaagaacaagaaatgaagatagaagaaaggtagaagtgaggaattaattaaaagttaaagctatagaaagctaaaaccttccattaataaacaaaacaagcaccaaatctatgaagatacatcgaaggaacgattcttcaaacacgaaatctatctttaagatgaccgtcaagaggaaagattccacaagcaagaaacctcatcaacattatttagctacaaaggtcatagactactctgattagagtttcactcgtcaaaccaatatccaaaatgatccaagtctaaatgggttgttctcaactttttatagtctaagatagatattacgaaaatacccttaatgaagagaatagcttctttgaataacatagcttgttgtggatgcgagaaagtcaattaatttagtatttgacgaatttttcttttgtagatttatttattatttatttataatataagtgactttatttattattctagaatagggtttatgtttcatagcttcataaggattaggttaatccatagttattagtttgaaataggatttatatttccttctttcataagaattaaagtgtgttgtaataagactcttatttaaaggagtttatgaggaataaatcaataagtcatatatcagagttctctctttcattagactctaaggtttgagtctccttttgttgaagagatcggagtgatctttttttattgtactctaatgtttcagcctctcttttaactagctaagtttaaatattgccatgtgaatcaattcttccgtatatgtattcaattgttaggaaacaaaataaatgattttaaatcgggaaaaggaggaacatgaaaaataacaacatattaaaaggggaaacatcgcagtaaaaagcagagaataaatagataacacatctgagcagcagctgttggtgttgccaatgcagcagctacagttgaaagagatttaagagggaggggaaacagataaagtctgggaacaacaacataccagtgtagttccgcaagtgaggtctagggagggcggtgtatactaattagttcacgttttgatctttaagcatcagttgtcaattttgtagtggggggaggtcgaaacattcaactttacacttgtttcaactgagtttctgttatagtagaatagcatggggtgctcaccagcacatgattttcatcttgaatatagaatattttgtgacttgcgcatacaattctttatgatggtgaagaagcttacatcatcctttttctgggatgattgtttagtgttatgcagagaagcaagcactaggagttgtagaccaagagctcctggacactcaggtgaaccctgctgtatgggaaattagtggacatatagtgcttaagcgaacaaaggattacaatgatgcatcagaggaatatgcatggaaacttctttctgaggtttccatatcagaggagagatttgaagaagtaaagggctatatttctgaagcagctgatctacaagcagatgaggatgaaaacatcaatccagagaaggaaattccagattctcctggtccgcaggtggcctcacatattcctccagattgtttggtgttgcagtgaagaatttgtggcttgctcttgcaagatctaataaaagtttgaagtattatctagtgtatggttgaaattttgtgtgtttgtttttccagcatcttgtttgatgcatactgttgtcttggttggaggttgtaatccccaaatagtgttaaacgtcatggctgcaagctgtggtctttggcaggattgtttacagtaccttttttgttggtgttttgactgtgctagcaaatgttcctaataataacaccagtgtaggactagcaagttttgtgcaggtgagactcctccttgcttttgacatggtaatccttcagcctcccggggatgtattctcttccatgaacgtctttggcttgtcgttaactcgatataatttccccccttatagaagttccataaacgttatgctctattggttcatatgggattggaacaagaaattcaacactttacgtatacttaaatcgttttatttaaatatggctgattcatatcacagaccaagtcattcttacatatgtctgaaaatattgcttgaaagttaatcttctttcaaccgaagatgtcaatttacgaaacaatgcttgacaggctgaagtaacttgaaagtttaaaggagaataactatgggtgtgttcagtacaagagaataaaacttttttagaaatgttctcagttttttcatgtctagttggtcaaaagattttggaaaacatttttccttgaaattgaattccataaaaattaagggggaaatgtgtttcccaattgtatgtagtaaaataagttatataaattgatattcaaacttcattatctccttcccacctacacaacactcccaacccccacctcttaactatcctacaccgacctaccccatagccatagtatttattagattacgtataagtgttttaagattttatttttttttgcctagttatcaaacattagatcaagggtgtgcatcagactaccctccacctaaggtgggcccgctcccacaaattgtgtgcaatcactactagtccctttacagggttaatttttcttggtttccctttagtaagttaataactttttgagaagaaacaaaaatctaacggaacatgtcaacaagctcacaaaataaataaatataacaaggcaacattagtaacaaagcacctaacagtttcccattattttttcattattccagctccattttttgttgtaggcatatgggattcgaaactcactaacacgactaatccagattcatgttcaggtagccttacggatggagtaaagagcttcctac

SEQ ID NO: 264 - DNA, 2972 bp, Solanum lycopersicum
taataaatttaattctaaaatgtatattttatttttaataaaataacatttaaaggcacaaaaaatatatgatttataacttattttagatcagaaattttaagagaaattatataattagacatacactactatcatgtatacgattattatccatactttcaaaatactatagataaactattaattaagaacttttcggcatgtattgaggaaatacatgtatttttagtatacgatacacttgaatagagagagaagcaagcaagatttgttatgtatttcgttcatgcgtgcatgtgtgtgagagagaatcacaaattggatgcatactagatgcatgtatctgtaagcacatgtgtgattcacgtagtggtgaatgagatgaaaggaagacgaataagatttgttatgtattctaggtacatttgaatccacttggatatagtgtatttataacaaattatatctaattttgatcttatgtgtctaagatatgtatttgtacatatcgaaatctgataagattcataatattataaataaaagtatatcgaaataattatctcctaaactagtgaaacatatgtatgtcttcctaaattttaataatatattttattttttaaaaaaatatatatacaagtcaaattatatcatataaattggaagcgagaaagtacttttttaacacccactttcaaccattgggacctacaatatgacacttttttctgaatcaatgattgctatatcatttaatgatattctttatagcttttggagcattatataaagctgacaaaccattaccacccaaagactcaaagaagaaccatttctttcttcaattcaacacattgtcaatttgccgcattttaattcatataaggtacttccctccgtaccctatttttgtcatacccatacaaaatcatatatagtcgatcccgatttatttgagattgagaaaaaagttattcccaatattttatttattatgattggcatgatgaactctgcacaaatgtgcaaacaagtaagatggcaaaatttgctacaattgcaaaattttcttcaaaaggacaaggttgtggtggtcatgggggtcaccggtgccggaaaatcaaaactctctatcgacttagccactcaattcgacggagaaataattaattcagataaaatacaagtgtacaaaggtcttgatatcgcgactaacaaaataacagaagaagaacgttgcggtgtaccacatcattgcctaggggtaattgatccttacaaagagttcaccactaaaaacttttgcaacatggcttcatttaccgttaactctataaccaaccgcggtaaacttcctattattgttggagggtcaaattcattcatcgaggcatttgtccacaacagtaactcatataattttagtacaaggtacgatttttgtttcctatgggtcgatgcatcgatgaacgtgctaaattcgttcttatacgaacgagtagataaaatggtggatcaaggaatggtggatgaggtaagacaaattttcaatccaaaaaatatggattacaccaaaggtattcgtaaagccattggtgtcccggaatttgacagttactttcgtgctgaattgtcaaattccgtggacaggcaaactcttgagaggatgctagaggaagcgattactgaaataaagatcaataattgtatactggcaagtaaacaattagagaaaattaagcgattaattagcgttaaaggatggaaaatccatcgattagatgcaagtgaagtattcaaaaaacagagaatagcagaggaaaaagaggcagaggaaatatggaagaatatggtgatgggacagagcagaaagatagtgcataaatttttatacgaaaattataggaattcaatggtttataaaactgatgggacagccattatggcagcagcatctcactattaaaaagcaaagttgatcgtcaaaaacacatctaatcacattttcacgagttttatattttaactattcattgttcgatgtacctacttaaactatcattcatttgtattaaaacacacctcgatgttgagttggcatacatgtgtcaggtcaatattgaggtgtatttttagtacagtgatagtaatagtttaggtaggtacatgaaacaataaagaaagttgaagtacgaaactcgcgaggaaaaaatgattttgatatatttttgacgattaactcatttagaaaaaaagaagttgtgtggttgcattaatctaaagactttttttgtacaatagttgagcatgatgaccagttttgggagataacatttatatatgtccactaccagctagctatttagcaaatcatatagttttatattatttttcactgatcactattgtaactacataagactgtaacctttttgctctgataataattggcacagataataaaataaatattttatgaatggttgtggaatgtttgcaagtagtatttcttttatgattaagaactaattaattactactcctattttaattacttgtcttagtttaattgcaatgtttggatgagagttcaaaagaattttttgaatagtataaacttaaaatgaaggtgtttataatatattaaaagtatgattttaaatcttgtagttatattattcttataagtcagtatcatatagctttaacttattagtaataattaataagagaagtcttgaaaaacgcttttaaatttagtgcgaattatttttaaattattattagtttttaaaaaatactattttatttgaccagctgaacttaaacatattttttatcttgcaacatgagtgatatacaatcctaaattttcaccaagtctaggagtgttttcaaccagcgcggagctagattttcaataagaaaatttaaaatctaaaaaaaatagatacacgaagtagcca

SEQ ID NO: 265 - DNA, 4972 bp, Solanum lycopersicum
acatttagcttaaattgactttatacttaaacaaatgaatttctctttaattaataatcagagtaacgtaatcctaaaattctagtatattaatcataaaacatataataaaaacacattgtaaaatagcacttgcaacatatctcgactatctagactgatatcgataatatattctgagaaacttcttttgtgatcatttattacttattaggttaaagataaaaactcctttgttttgatgcaaatagaataatacacaaccacctttaactctcactaatgagcataaatgattaaaatgtttaaaacaaaattgaattgtatcattagaaaattaaaaaaagaaaaaagttaattcatttttttattgctataaatatttagttttaaatctatccaaacaaggttcgaaaagaatggaaaaagattagataaaaaggatattgacaattcgcccgataaaagagcctcgtgattgattgattgttagttaatcaactgatagtggccagtggggtaccaccatcacaacgacagcgacataacgcgtttggcgtaattgcattacaatagcagcctctcttttcttgtacaatttgtgtaaatgtatctattatagtcaaagccaccaattttgactcaacacacaaatagtattattttttagatttcattttccacggtcaaagctattttgaggatcttagaagtttctttaaatatctatagaatagaaaaataaaaaagacaatgagcttggatgacactgttttattttttaattaaaaactttagaatttatatttgacagaaaggaaattttattaaaaatgtcaattatcaaataaattattaaatttaatcaaattttaatattatcgagtgagaaatgaaaaaaaaaaagctagtggattgtagaatacgtgttcatttttgtttttaatatcccacccactccaaacgaaaggttatataatcgaattcccattgcactcttgtatcttctttcttttaatggctgcttcaagtttctcttttcccacttcatcttcttcattcatgacgacttctttcaccgaccttcttgcttctgatgattatccaaccaaaggacttgctgatagaattgcagagaggactggttctggagttcctaaattcaaatctcttccacctccttcacttccattatcgcctcctcctttttcgccttcctcttactttgctattcctcctggtttaagtccaactgaacttttagactcccctgttcttttgtcttcttcaaacgtatgtagtaaacccctctctctctctctctggtctattttaaaactctcttctcattggattcaagattattgatttttttcttttgaaattgtaattgcagcttcttccatctccgacgactgggagttttccatctcgtgcttttaattggaagagcagtagtcatcaggatgtgaaacaggaagacaaaaactactcagatttttctttccagcctcaagtagggacagctgcatcatcaatctctcaatctcaaactaaccatgtccctctggtactccctcgtctcaaattatctatcgttttttgttttttttcgctttacatgagggttgaaaactactaaaccttgtttatattcaagctataatctctgtttactcaattttatgtgtttatgtaattgttgaagtcatcttgtcaacgaaaatgagtagaaaatcttaattggcaattaggaatagagtaaattggcaacttcaagaagtaattgcacacaatcatttgagacggatatatttaggcaaaactacagataatttgagacggggaaagtatgttttgtgtttctgtatttgaattctaacttgatttgtgaagtgttttaagttaattgactgactctctattttcttcttgtgtaaaattgatcaggggcagcaagcatggaattgtcaagagcccacaaaacagaatgatcaaaatgctaatggaagatccgaattcaacactgtacagaattttatgcagaataataatgatcagaacaatagtggaaaccaatacaatcagagtataagggagcagaaaaggtcagatgacggatacaattggaggaaatacgggcagaaacaagtaaaaggtagtgaaaatccgagaagctactacaagtgtacatacccaaattgtcccaccaagaagaaggttgagagatctttagatggtcaaattactgaaattgtgtacaagggtaatcacaaccatccaaagcctcagtctaccagaagatcgtcatcatccacagcttcatctgcattccaatcttacaatacacaaactaatgaaattccagatcatcaatcctatggttcaaatggacaaatggattccgttgcaacacctgagaattcttcgatttcatttggggatgatgatcatgaacacacttctcaaaagagtagtaggtcaagaggagatgatcttgatgaagaggaaccagactcaaaaagatggtaagtgaaacaataatatattatgtatagtcaattctttctataacatcattgttatcatttgtactgttgaaggaagcctgaagcctaatggaacatgtcaaagaaacaggtccattgaagttggctgacgagttagagttaacagtactactaggactagactactctaacccttgcagtgaacctgttcctttgacatgttccttcgggcttccttcaacagttccaatattttttattgctatagtaaaatgtttgttataaagaacatataatataacgtgaatgatctcttccacatgaaatgaaacatcattgttatagtaaaatgttgttatagagaggtctatattatagtaatcttggatccattttttagctaatgttaacatttttaactttgttgatttcttgttttcaggaaaagagaaaacgaaagtgaaggtgtatctgcactaggagggagtaggacagttagagaacctagagttgtagttcaaactacgagtgacatcgatatcctagatgatggttatagatggaggaagtatggtcaaaaagtagtgaaaggaaatcctaatcccaggtaaataacctcatctttgatccataaatttggctcgataacaagtttggaagttccttaattttgaaacaaaaaatgaatctaatttcttgattgggtactatgtaacaggagctactacaaatgcacaagtacgggatgtccagtaagaaaacatgtggaaagggcatcacaagacataaggtcagtgataacaacctatgaagggaagcacaaccatgatgttccagcagcaaggggcagtggcaaccactcaattaaccgacctatggcaccgaccataaggcctactgtgacatctcatcaatccaactatcaagttccattacaaagtataaggccacaacagtctgaaatgggagcaccctttacactagagatgttgcagaagcctaataattatggtttctcaggatatgcaaattcaggggattcatatgaaaaccaagttcaggacaataatgtgttttcgagaactaaggacgagcctcgagatgacttgtttatggagtcattgctttgctgaaactggaatcctagaaaggagcacgaattgaagtttatgaaacgaaaaactgaaccttttatttatttatttttgcataaagaatatgataggaagcattttgatttcatttgttaatagatcatatactgtttttttttttggtgtgtgtacattttgtactaggaaatttgtttgttgtaaattcaatcaaatgcggtgtagatgttcatgcagttaccactgttatgggggttatataatttaggataggaatgtaaatccccaactcatgactatatgacactgattctttatttctatcacattttcaagttttatatattaaagaagattgcagtttttcaagattatggtaaattgagaacagtgttttcctagcagttttctttcaatcaaatatgtatccaatcgtagtgagaagtactctaattcttttttctttttccgtaaaatcgtttaatgcttagttgttatagctccaatcatcatcgattagatgactaaatatgagacagctaagacttagttagattcaacccctctgatacatgtgtatttatttggtcctaggccactttttgctgatttaatgtttgattggtttgactttgacaattttttaaatccttaactttttgcttcacatgttttaaaaatcacaaaattatcattttgatacatttagcgtatttttagcttaaaacacaagattcataaaagtcatcatctattttttgaaattctaggacaagtcaaaaatatcttaacaaattaaaattgaggaagtaaaatatatgaagtatggtagtatcgaaataaacacgtgtaatacgaaagctagcaaagcaattctcgaaaggtcatgagtaagaaaataaactagaaatatattaaaagacagatttaacgtagttcagtcaattgacctacgtccaccactataaatatatttggaatacataaatgttcacgcaagtaataacgtatcaaagttgcatccacaaattctttgattaaccaaaaataaatatgctagtgatgttgttgcctaccattgaggcgccataggcttagatggaagaaagatcaaagctatggttacgaatctctaccgcgtactgagacaagctgcagttaatagtaaatcgtcatggatattactaagaaccttcaattcatggtcttttgctattaaaagtgcaaaatcacctcaacgagccttgacactctatgcccagatgcagcgccaagctattcctttcgacagtttcgccgttcttttcactcttaaatcttgtacctatttgggtaacctttccctgatat

SEQ ID NO: 266 - DNA, 2964 bp, Solanum lycopersicum
cttcctttcactaataactcataaacaaaacaaatgatacgaaagaagatagaagttatatatttaaattttttattaaactaagtcattatataaagtaatttatcaaaataatacggcttttaaaatttttacaaaattagtataaacgtatttcactgtagcgttttatggtatatttcattttttaaaagctgacggcgttaggttgatatacatcagtgtaattaacattttactcctaaaacgttactatgaataacgttttaggattaaaacgttacttacagtaacagtaataaaacgttattacgagtaacgtatttcaactaatatcgtcggcttttaaaaatgaaatataccctaaaacattactgtgaaatacgtttatactaattttgtaaaactttaaaaaacatattattaataaattactttatatattgatctagtttggtcaaaacgtccgtatattagttagagttatgacaacattcatggggcgggcttccaaattttatgaagcaaaaaactgtacgttcttatcgtaaaagaaaatgaaggttatcactggaattatgagtcatagctttgctgcctctcttacgatgccacgtttacggctattatagactgcaaagagtcttgaaatgtcggtacgttcaaaaatgaatctttgcaagtgtgtactattaattttacttttttttaatctttatgaccagtcaatattacacttggcttccagtctatgctcttgaatgtctcctttcgagtttctgtgtttgggttttagttaaatatctgtttatttatgccgacactcttacacttgtttccaactttcatttgccacgatcccgctaaaggctccatccattactcgcttaacacctgttgtgcctctaatcagcctatcctacttttactttccctatataaatccctactccctgaacctccatacttgaatgttatctgcagtagccaaaaacaaagtaaaaaattaaacagtgttttttaaaaaaaaagaatttttgatcaaagatggcacaatacggcaatcaagaccaaatgcgcaagactgatgaatatggaaaccatgtccaagaaacaggagtctatcaaggtaccggtactggcggtatgatggggggcacgggtactggcggtatgatggggggcactggtggagaatatggaactcaaggcatgggtactggtactcatcaccatgaggggcaacagcagcttcgtcgatccgacagctctagctcggtacgtttcgttaatccagtatacgattgaatacaattgtgtgagcacacttttatcatttgattatattttcaacaattttcaacacccatcagatcatattataacattaacatatcaaccgtaaacttggagtatatgaaatcaaacatttcatgatattctaatggcatggcacgttactaacgtgatatttttttaaattaaattatgatcagtcggaggatgatggagaaggtgggaggagaaagaagggtttgaaggagaagataatggagaagatgcctggacaacatgaaggtgagtatggacaaacaacaggtgaagagaagaaaggaatgatggacaaaatcaaggacaagatccctgggatgcattgaacacctttgttttcatctccatcttatcttatgaataaataaggtagtgcttgattctatttcatgcactaattagtagtaatcgttatgccagtaattatctaattacgtacactcttgtgtttaaagtcgtgtaaagtgtgctgacgctatatacatgtgtgtgtatattggcggccatgccctgccccttctgtatttttaaaacaagaatattgcttccatgcttggaaagcaatgatcatgttgatgtgtgttatggtgtcccgtgtttaatgatgttttggaaataatataacttgtgctatatttcttttgagttcaagtttcatcctttaatttattaaaacgagttgaagatatactagacaaataaatgatttctttatcatcacatacaaatcaaataagtaccattttgctaccatcagcaaataatttctgaaacctgactctctgtatatttagaccaacttgggctacgaatcctcattgttgaattaaggtctgcagttggattaaatcgaatgtttagattgaatttttatttggattagcttttttatttttatcttttttgattgttcggataataagttactttgtttggttttttggtttgattttgaatatcaaaaaataaaatcaaagttagacttgattacttttgtccctactgtttgcttattgttttttttatgatgattacatgtttgaacatctataataggtgtatagataaatattgtgttttaagttttacttataatttatattagaagatgtgtttatgggattaaatattattctctctagtccgatttatatgatactttttatgttttgaaatttaaatattttaagttagtcgaaaatttgctcataaaatttttaattttttttaaatgaaattttgtatttgtaaactacgtaaaaggtactatgagtcacaataattgataatttataatgttcaaaaggtctataaaaatatttacggtcaaacgtagatttgtttaacttttgaaattcgaaaggtaacatacaaaatggaacaaatggagaattataataaaacctctataaattaatatagatggaattatgaaattttattattttataaagatgttatttaatcaataaattaatatttattaatttaaagaatggtttgaaatttagcgaaggttaattttgaatataaaattattgtatcttactaaccttatgatgttgaataataagagctttcaaagtgtattattgtaataaagtttatcataggatattagaggattatgat

SEQ ID NO: 267 - DNA, 6739 bp, Solanum lycopersicum
aggcacttggattgaatggagtgaaattaaaattaaaaaaaaatactgtagttcaaaaaagatttttagaagttgaagttgtgtttggacatatatttcacttgaagaacggaataagagaatagttatagagttttatgtacataattaaactcaaatcttttaaaagaattgtggtaatcaatgagtttaaaaggtcgccttccttcttgataattaagtaattttggggaaaatgtacatcacttggcaagtcggcatcctaaaaactatataatttattgattgaataccacaaactttttttcacaagaaaaatcaagagtaggtgcaaacgactcttgtaacatgaaggtgaacaacactgtttgtgagcatgaagtactgttttattattcttgtaatgtaaatatacctgtaaatacaaattttatgtaaaattttaaataatattgatttgaagatatatttttaaagtgaaatgttgatttacacttgcaaatcttcaactttctcaagttcagtcgaggttccaatacatacattttcacaaatttcattgttactaatcatatcaaattttatgcaacctgaccagatggatataacatttcttagatcagaaatatatcagaccttgattcaaaaattaacgtgactcaaagttagcgaggaccaatattttcactgctaatttgtccataaatattcataaatacttgaagcaattaatcttaattgaaaatattttgaatctaaagtaatattgatttcaaaactcaaaaaatctttatatatttacaatatttttgtttcagctcaagttttatttaaataacaagcaataacatattcaatttaatttcacgagtgaaacctatacacaaaaaataaaaaatattattttcaataggttgttgtgtcaagaaattaaattacatttagacaataataactaagtatttcacttgctttcttgttgaactccaagcccaaaaatgttcaaaggcttactaaacagtttagcaaaggatgttttgtgtaaaataagccagagcccaaaatttgttccggtccaaatccccgtattcagtaacgagcaacattttctgcacttcaaccaacgaccaacaaccaccgcagagctagtcaaaccaccactactcacggccggtggtatccaattctgagctgatggccagtatcatcggcgtatcatcttctccttttccaacccagacctctcatcttcttccatctcgctctaattccatatcttctctcgttcaactcaaggtacagttactcttcatctcttcaagattcactttttttttcttcttctctaatgttgacatttttattgcttgattcttaaagagagattcggttcggcgactgttgttgcttcgagtgaactgctcatcaaggcaggtcggagatgcagagacagaatcagaatctaaggtggtattgccagatactcctgctgatacaggcatttcagcatacaattggtgtgcagctcttggtgggattgggtttcttgagacttcttacttgacgttcctcaagttaactaactctgcagcattttgtcctgttggtgatggtgccagctgtggcgacatcctcaacagcagctactcagctgtatttggtaatatcccgtgctatttttaggaaatctggactttaaaagaactttctgctttaggactatctttgtaaccttctataagtatatatctaaaatttttgtttaaaagaataatatgaagatattaacacatctgtacaagtaaaattggtgggaacctgaagaagtgattggatacaatttctattttagggttttggcaaagtctaaccaattcacgtctctcttttatgactagcctcttgtttgattctctttatgaattatgtacgtaccagacataataatctttatccctattacctcaatttagtgtcttattttgactaagaagttgaagaagccctttttaagattttagtaaagaacacataattctaccttcttgaggtaggagaaagatctgatgtacatggtacgccaccctccccagaccgcacttgggattacattaggtaatgttgttgtatagaagaccatgtaatgcaataggattgctttatttgtttgtaagaaaatattgtttggaagaataaatagaggaatacatctatttatgtagtataatatctctgaaaacatatcctttgtaatgaaacatacaaagatgacaatggtaaagcttctaattttaaatggtgatagtaaatttgttgtattgcaagtaattgtagtaaattaattagttctatatgggttgtcaagctagcgtaaccttcctcctttatccgggcctgcaattagctatagagcaagctcgcacaatcagagtttccccggggataaccccatcccagtactactccagccaaagcatgttaactttgcagttcatatagctgacccaactaactaggaaaacatagatgttgttattgttgtacatggagagagtaagttatgcttgtttaaaacattaatttaggacataatatgaagttggtttcaagaaaccttactaaacacaagatgttattagctgaagaaatctattgttaattagaccagcatatgtttgataatagcctttttttaagttacatgatcttcggttgtcttcaaatgagactctgtaaggtagatagtttgaattatcaatgaatgggatgcctagaaatgcaatcggactgagaaacctgtgctgtacccaattcgcctccataaggtcaccgtcatttccacccactccaattccagtactcattgatgaatcaaaggacttttccctatctcagtgttacaataagccggcacacattgattgcagtgaggttacaaaactccagtgtggagccagaattagaaaaaccaatatcaattggtccaacatacttgacaagaagatgttgacagtaaacattgctgtaagttgcacccattttatctcatagtggtgaggcctcaacataaaccaattcctggaagtagcaacacctaatcctcgtactgattgggctctaattgctcgtaaatctctcatatactttatgtgcatagtgtgcataacacacaggtgaattgttcgacctttatcgtgtcaaaaaaaaaaacactggggtgatttgttcttctaacaaaatgttataactccttttgatggtaatcatacatatcacagaggaggtagcacattataatatatagtagtgtattttgttgtcagacttaataactaatgcagtgctaattttgttacattgtaagctgtattgtttgatctgaaagacacagattggaaaatcattaaattgaaggcagtatgtcacttaaattgcaggtaatatgtttggaaaaagattcagttttcatcctttttcatttgccaggtgttcctcttccattaattggtatggttgcttatggagtagttgcaatacttgggatacaattgggccagaaaagcaggcctcttggaactggtgaagctaatgggcgtttggttttacttggaacaactacttccatggcagctgccagtgcatacttcttgtacatcctaagcacaaagttcactggggaattttgtccgtactgtttagcttctgtcttattgtcatttagtttgttcatcagcagtatgaaggttatctctactacagacttgtttgtttagcttctattgctatatgcaatggtagtgacaaagatatttcttttatatacagggtttgggctttcaagaggtgcaaaaagatgtgggtatacagttacttatagttctcttggtggtttctaccctaaacaattcatacagtgactctcagcctacaaacacagggtaaacaatccgtacacatttacacattgtaggatgatattaggcaaagtgtctttggattgaaaggacaataggcaagagtttctttttttgcattaagtagtgaatgtttgattggcattgattaaagagataatcacattaacttgtataaaaactttccatgaattatttaagctagaatcttaaagcaagtaagagaagcttgtttcagtttctagatttagcagcaacaagatatcttggtcattttaagatagaaaagctcttgatgtgcagtcatttagtcacaggtaaaactctagatcatctgaaatgtatagttggtgaaaagatcatgcacgttattcaagagaacaattactcaaaatccttttcccatcttttgcagttctgctctggctgagatggaatactttacagcagagatcacatcagagtctacaccttttgctatatccctagcgaaacacctgcattcaattggggcaaaaatgtatggggctttctggtgttctcactgccaggaacaaaagcaggttctctttcttttgcaaatgtgctttcttagtactgcattttgatgggtttctcaaaaaaaaaaaaaaaactgcatatgaaaatgatgttttttctaaaattatttcctttttggttgcctcaatggcatagtgacatcatttcattaggcaaaaaaaaagattcagagaaagaaatacttgcatacatagaaaatgggaaagtaaaatctttccccattatcaaatctgacatgatgtaggtagggtgaagcgtggatgttgattggactccagccacgttgtctgattgctacattcctaaagtaacattctataagggaaaagacaaaacatgatatgggtagggaagaatatgaatatgcatcaactactattgggttgaatattaacgtcttccgtaaaataagtaagagcatcattaaagggaaaaagagagacccttatatttccttctttcgtatactggtgctggaatttggctaagagcttctgtggattaatctttaaaggtcagaagcagatactcagagttctgaccccaactgtttgtcaatattgcaactaaacattaagaatataaaaaatggccttaaagatcccactagaaattctgatttgcattatgcacttagcagtataggtaagagttggcttgtattctgtactaaattggtatattcttgtgtcactgcaacaagatgtttggacgagaagcagcaaagttactagactatgtagaatgctttccttatggacttaagaggggaatttctatgatcaatgcatgtcaagaagcaaaactcgaagggttccctacatgggttatcaatggggaggtgagcaagaaccttcttcatgctagaaaaatattttgtaacctatacaaaaggcaccagtcattcacacgttcgataagaaaatgaacatcttgctgtgagggaccttataactataatattctggcaggttcttagcggagagaagaagctttcagagctggctgcactgtctggtttcgatatgaaagaagaacttactgaggctaaatgagctctgttgatcaacagtcacatactcttaggatatctaagtttatgaattcttataactgccctctggtatttacttagtttcataatgtaattaccttcttatgttagtaaaactgaataggtagtatgataaagtgaaggatccgagtggatcatcttctgagtaaatatatcaagcaaatcctattacccacaatgttttgttctaaagttgtacatgtccaatttccccctgaaagtctatttctcttatttttatcctatgccaaactttggcgataactttttccctaatctgaacccattgtgaggacaatctaatggcaagtgtaatctgaagatgaaaaagtatctcatgattattctttttgtatgtaagagtgattgtatcccataatgtgaatgatcaactcttgaaatgaatttccctggttaatttcctatttacaaatgttttctaaagtgaagacgacacagattgaaggagtagagatgtatgtcgaatgtgatatgagtaagcaaatcgtacccaacaaccttatgggatagagatgttgtttttggtagctattaggaccttggatggcatttgtagttttttaaaatatgggtagctggtgaccgttttttgaaaccttggatgaaatttactctaggagtcaatttcaaagagtacatggtgacttctgaaaatattcaacacttcttcatcttagtgtacaatgtatattattagctaaaatctattttatattaaggaggaactgacttggaattttttctctaaacttatcaatactaatattcattattttgtgatcaagaacatcaattgaaatacttaacttcttttaaaaaatacaaatcatttcttattttgaaattttaataatcgtgtcaaagcaaaaatagagcgcttaattgaatggtgagtttaatattgtagttaaatatttaataaaagtttacttttgaacatgaaaaccccaaattcaatactagattgatttagttcaaaattaactttgctttatttaaaaaagggtccatgtttgactctattcaagatccaaactctgaattttttatatttagtgaaatttaattcttgaaataattgaaacagaattgtggaaagtcataatgttttgttttttaaaagaaaaaataaataaaaagaccttcctctgttgttttgggtattgag

SEQ ID NO: 268 - DNA, 3672 bp, Solanum lycopersicum
agtgtgatcaacttataactatgaaatactacttaaaaggtaactctaaaaaacacccccactatattgtcaatcaatgctcattaggataagaagtcttagcacccccactaaattctcaatcccaattcatttttcttttgtcaagttttgaaatactagttcaaagataaacaaggatgctaattaggtctttgaaaaactatttgagagatatataaggaattttaagtataaaatatcaaaaaaaattcttcttcttcttttgttatgtgaaaagtatagaaataaaatttatttttaaaataaaagaaataatcgtctcaaatcaaatagttagatgacaccagcactgactatattaagaatatagtgaaagagaagagtatggttcaatgggaaggttgagtggtgatggttcaatcacccaaccaaaggaaactccaaacaccattgggaaacgttttcctgtccaacagtacaaaagacaaacaacatatggatttttttatctctattttaacctttacaaacttctctcatttatttcgtttgattataaattttgaattaaaattttaagttgtaatatttgtatctagatatatgtattttagtttttaaaaattaatacatggataaggggaaaaaatgaggagaaaattataaagtaaagaattgaacttttatcagtaaaatgaaagtttatatattcaatcgattgagtcataaagatttttcaactgaaatttctatgatcattttttgaaacttaaaataattagtctcaaaatctattactatcaaaacataattaatttatgagaaactcttctatgatgtgaataagaaataaaaaagacaaacaacataaggacctctatctcaattttaaggattgctaagccctttttagcaatttattcatttttttttggttaagtgagagacctataagattccaatttttgttcacctattttcccaatgaacggccttggcttttcctttatctcaactctctctctctttatatttcctttcaatttttggctcttcacaaattataattaactagtctttgcatgcaattataatggctattgattgtatgatcacaaatggaaaatctcccatgctagatgaaaaaaaacaatttatttttgatgcatctcatatgaaacgtgagtctaatattcccacacaattcatatggcctgaccacgagaagccttgtgccttagtacaacaacttcatgtaccccttattgatttaaggggttttctttctggtgaccccgacgcggcccaacaagcatctgagcttgttggggaagcgtgtcggggtcatggtttttttcttgtggtgaatcacggagttgatgctaatctcatttctaatgctcatcgttatatggatacgttctttgagttgccgcttttagaaaagcaaaaagctcagagaaaaattggtgagcattgtggttatgctagtagttttactggaaggttttcatcaaagctaccttggaaagagacactctcttttcgttactccgctaagaaagaatcatctcacatagttgaagagtattttcaaagtacattgggcgaaagttttaaccatctcgggtacgaacaatactactatgtttatttgttttagctgagtacaagattcaaaaaaatttctttattattttaatatttttgtctcactcagaaccaaataaacaaattaatatatatataaatgagttaaccttttttccacttaaattatacaggaatgtttatcaagaatattgcaattctatgaacacactttctcttgggatcatggaactcttagggatgagcctaggtgtagagaagagtcacttcaaagagtttttcgaagaaaatgattcgataatgagactcaactactatccaccatgccagaaaccggagctcgccttaggaacggggcctcattgtgatccaacatcattaacaattctccatcaagattgtgttggtggacttcaagtttttgtggacgatgaatggcgttccatcagtccaaatttcaatgcatttgtggttaatataggcgacacatttatggtaagatatttttacatcgtaacaatgaaatgatatatatcatgtgtgtttaattaggacgtacaacatgaatatgatgtccacatgtatatactcccattgaacaagttgaaatataggtgagaaaatggttacataacatgttttattattttgccctttttgcaggcgctatcaaatggaagatacaaaagttgcctacacagagcggtagtaaacaacaagactcctaggaaatcacttgctttctttctttgtccaaacaaagataaggtggtgagcccaccaaatgaattggtggactccaacaaccctcgaatatatcccgatttcacatggcctactcttcttgaatttactcaaaaacattatagagctgatatgaacactcttcaaacattctcaaattggcttcatgatcaacacaacactactacacaagcttaagagctacaagattgaagaccttgaaaattttcttttaaatatatgtacgtgtacacgttctcttagcttctactaagaatatgacaatgtatgggaattagggggaagaggcacaatggaaatgtttctttcaaaaatttcacaagaagaatgaaaatttcgagttaaaaaaaaagaagtaaatatagaggagatagggaaggacaagaaaggaataagcgttgtataacttagttttgtttatttaacgtattgaaaaaaaaatgtagagaagattatgaatagctagctttactggtatccaatgtatgcatccctcattaagagagaacttttgaaacctcttcatttgatcttttgtttctcttcaagcgtctcaagcgaattatgatctaaaaatgaaaatcaaatgaaggctttaaattttttaaaacaaattatatatttttaacgaaatttctttcttctagatttttgagattgaaaaatagttatactaacttttttaatgattctttttaaattgatgatatagttaaatccgttaagtctttctctgagatagtattctaaatgtgtgaaatagtacttactcaatatttttttctaaaaaaaaacaaaaactataacctattattattaaaataaaataaaatggaacccattaaatttggaggtcttaagtatctttgctgctcctttacgcagagcaactataaaattatcttcatttcgaatcaacaaatcaacgattgacatttaatattaggataaattacatgtctacattacatattttagaatgtgaccttttttcaaaccttgcagggtagttaaacattatagtttttagaaaatgccacaaattaattttgtatggacttacttgatagcataaaattgatactattagatgcatcgaaaagtttgaaatagaaagagatgaaggggtccacgtagggaatcatttcaaaatactaataagtccagaagtaagaaagagaaaatgagtggagaggtaaaataaaatccaaaatacgtattaatatttatatatacatagctttcaaaaattaggatatggattcttgtgcaagtgtgtttgtttttattctt

SEQ ID NO: 269 - DNA, 4910 bp, Solanum lycopersicum
attgtattctcaacttttttctttctcacgtgtagcttctagcttgaacatgaaatttcatataactatttagacgaaggcaattacgactaagggtatgttcgataagaaaagaaaatattttcttaaaaaataaataaatttttaatttatttttcatatttgattaataagcagaaaatatttttgaggaagtatctttttttatttttgagaaaatactttctatgaaaataattattgatgtgaaaatcaatctcgataattgttgcaggaaacgactctgacaatcgaattaggataaaacctcgatgacctttaaaatcgaccctaaaatctgatccaaaactcgatccagacttccgatccaaaacttgattcaagtaaatatttttaaaaataaattctttttgacagggtggcgtaaaaataattttattttaaaatatgatatagttttctaaaatatatttttttgtttggttgttgggggttggttcgaggctaggggtaaaaataattaaaacataagaaattttaaaagttttaattgcattttttttgtgttggggaggggcggattttgggttggataagaaaaaatatttaaagataaaatagaattttggaaaatatttttcttaatttttgaaggaaaatcatttttcttaaatttgagaaaaatgaattattcttaaaaaaaatttccaaaaacatttaagctaccaaatatgaaaaaataaaaaatattttttttcctaccaaatgcaccctaaattagtcaaatatccaacatttaaaagagctatgaaaaaaaaaagaagtaagaatcgtagatcttcttttaatgcgtacttttattttccaagatttgaacaataaaatagacttttctatttttattttctgatgtaattcttatatacgttagtcgacatgttctcattacatacttcagtctttccccttatatatatccctcacattccttaattctcttacaccataacacaactacaacaaacacataatacttttaatacaattagttatttattagaagtatttaaagtaaagcacttgtgagttgtgtacattttattaatcttcatcttcttaattctcttcagtttttaatttcttcacttctaaactcatttagtaaaaaaaaatgggatttgagattgcaaagaccaactcaatcttatcaaaattggctactaatgaagagcatggcgaaaactcgccatattttgatgggtggaaagcatacgatagtgatcctttccaccctctaaaaaaccccaacggagttatccaaatgggtcttgctgaaaatcaggtaattaattatcctttatttatatattttgcagtttgaccaaacagactattataatttttttctgaaacctcgatggtgttaaatttcttttgtagctttgtttagacttgatagaagattggattaagagaaacccaaaaggttcaatttgttctgaaggaatcaaatcattcaaggccattgccaactttcaagattatcatggcttgcctgaattcagaaaagtacatatcgtactatagtcagttaaattatattgatagtataaaaattcgttaatatatttaactaacgagtttatttaatcaggcgattgcgaaatttatggagaaaacaagaggaggaagagttagatttgatccagaaagagttgttatggctggtggtgccactggagctaatgagacaattatattttgtttggctgatcctggcgatgcatttttagtaccttcaccatactacccagcgtaagtatatttaattatatatgtgtaaaaaaaattaaaatcatcaaatcattttttttatttgtattaccaaataaattgtctaattttcaagattgtaacacattcatcaaagtacctaataatataaacgattcagtatattaacgatgtatataatttaattcctttggcggatttgtctttttatgttgggccatcagaagaacattctggtgtattaattaattaattaattaataatagatgtgttgtcattcttttttaagacagcgagagtttaattagtcttaattactggattatcacgcaagctctttcttgaattttattattcttatattaaacacatgatagcataatatctttcttttgtggaatccagcttgttcgtgaagctttgtattcacacttataaaacaacaaaaaataaaatctggtggtaattgattaaagagagaaatataaaaaaataatagtcaaatagactaataaggaaagaaataaaaaatacacaaaatactaaaaaaaaagaattaaggtatagtggtctattattgagaacttttttgaagaattgaaccccactttaatttcttgcttgacccgtgaccattgcttatcgaggtaaaataaaatttcaaacattgactatgacttgttagagagtaattaccacaagtcaaaattttgttactctgtctcgttatttcattaggatcgataagataacatctaacatatatatcttttttattagtacttgtttatttttagtaaaagcacgttatacattttacaatagtcaattgttgcatatattagtatatatattttgctaagtcctaactaacaatatttttggcaattgactaatgcagatttaacagagatttaagatggagaactggagtacaacttattccaattcactgtgagagctccaataatttcaaaattacttcaaaagcagtaaaagaagcatatgaaaatgcacaaaaatcaaacatcaaagtaaaaggtttgattttgaccaatccatcaaatccattgggcaccactttggacaaagacacactgaaaagtgtcttgagtttcaccaaccaacacaacatccaccttgtttgtgacgaaatctacgcagccactgtctttgacacgcctcaattcgtcagtatagctgaaatcctcgatgaacaggaaatgacttactgcaacaaagatttagttcacatcgtctacagtctttcaaaagacatggggttaccaggatttagagtcggaatcatatattcttttaacgacgatgtcgttaattgtgctagaaaaatgtcgagtttcggtttagtatctacacaaacgcaatattttttagcggcaatgctatcggacgaaaaattcgtcgataattttctaagagaaagcgcgatgaggttaggtaaaaggcacaaacattttactaatggacttgaagtagtgggaattaaatgcttgaaaaataatgcggggcttttttgttggatggatttgcgtccacttttaagggaatcgactttcgatagcgaaatgtcgttatggagagttattataaacgatgttaagcttaacgtctcgcctggatcttcgtttgaatgtcaagagccagggtggttccgagtttgttttgcaaatatggatgatggaacggttgatattgcgctcgcgaggattcggaggttcgtaggtgttgagaaaagtggagataaatcgagttcgatggaaaagaagcaacaatggaagaagaataatttgagacttagtttttcgaaaagaatgtatgatgaaagtgttttgtcaccactttcgtcacctattcctccctcaccattagttcgttaagacttaattaaaagggaagaatttaatttatgtttttttatattttgaaaaaaatttgtaagaataagattataataggaaaagaaaataagtatgtaggatgaggagtattttcagaaatagttgttagcgtatgtattgacaactggtctatgtacttagacatcataatttgtcttagctaattaatgaatgcaaaagtgaagttatgttatgactcttagaatcttttgatttattggactttctcgattatattgttattattaaatttcatatattttatatatttaaaaagtgtcgtaagtcataataattgacaagatatatgaaaactttacgatcaaagataaatttgtttaaattttaaaatttaaagtgtgtcacataaattgagatggagagattatggtgtttgtgtatattttaatggaaaaatacagtgcgtgtttgtgggggattgactccagatgatagagtagaaatggatctcctaatttttttatttatgttttactttatcgagggtctatcaaaaataatttatctattttttaaatagagataaagtctgacatactctttttacttgtatttatatgtcatgattttgattaggagtttggattttctctacgttcaaatacaaattaaactataatgagttattttccctaaatttggagaaattatcatttggagatgagtacacgataataatgtcctctaatcaattacatcaaacacaaaaacattattagaaattcacaatctacatgtttgtctaattaatcacatcttcatagttgataagtagtacttatcatactttgtagtttatgatttcgaataacttgacatatgattaattttgtaatactacattactgtttatcaaacttgtttttcgaattcatttctagtagtgtgtggcatgacttggacaagagaaatacaaatattttgaatttattcctactatacattttattttattttaatctatatataaaagaatatcgtacatatttattaatataaaattttgatatttactttttattatagaatttgatatccagtcaaaccgccacataaattgagccaatatgtaaatagaaaatgttgacaaaagaaatggatttattggaagacaaactgacatagggtccaactgaaaagagttaaattgtcggacgactttataatattttagt

SEQ ID NO: 270 - DNA, 3729 bp, Solanum lycopersicum
aattcttgaatgtcacgtgttatcatgtttgacattagaaaattactaatactaaaaagtgatttagtcttaaagtttatataaaagaattaaagtttgataattaatgtttcgtagtaaaataaataaaataaaagtatttagaattaagaaaacaagttttgggttttgtagccccacttgagaggggagaccgggataagtggccgacaaacagtaagagatgggccagtaggagagggagcaaatggaccatggcacggtcatcgtcggtccaatttttggatgggcttatttctacttctacccattgttgtcttttggattttcttaactcacccacaaatgattcatatctcacaataatcatatgctaaattgctaatattttcattttagagaattaagatataattaattaattattatgataacttttattcttactcctactcaataaggagaggaattgaagtgatactattaaattaggataaagaaataagtggagagggtagacataactcataagtactacgctgaaatcccaagtaagtgtctgtagtgcgcttaggtaacaaggaactttaattgtcctttaattactataacattaaacactgaaattaaacggtgctaaacgcgttaaattagatgaatacttgaaaagagagagttatttatttatttaattaaaaaggaatttaagagtattatgcgtagtttggctgacgtgtagttcctttgattgacaaattcctatatatagacatacattatgccagcaaatggcaacaacatctccctagctctcttctataaactacaatctccaattcattccaaatcaaactttgttttcaacaacaaaataaaaaacattcaaagtgatccgattacatcctactctttcttgctggcacattccagtcgaccaatagataaaatttatttcccaaaatatacataaaagtccagtaaattcataacaccagaaaatatgaaactattgtcagagaaagccacgtgtaattctcatggacaagattcttcatactttttaggatggcaggagtacgagaaaaatccatacgatgaaattcaaaatcctaaaggaatcatccagatgggtctagcagaaaatcaggtaatttgaaaaaaatacttgaaacagttctgtttttttaagaatccccatcttcgattgtcggctttcacattctttgcactaacaataattttattttattttcgttacgcagctttcatttgatttattagagtcatggctagcacaaaatccagacgcagctgggtttaagagaaatggagaatcaatatttagagaacttgctctgtttcaagattatcatggtcttcctgctttcaaaaatgtacgtatttttaatatattgttcacatgtattatgaatacaaaaatatattaaatattacgtatgtgtgacatcatttatcttacgttgttatgtttatttttataatgcaggcaatgacaaaattcatgtcagaaatcagaggaaacagagtaagctttgattccaacaacctcgttcttacagccggtgcaacttccgctaatgagacgcttatgttttgcctagctaaccaaggcgatgcttttctccttcctaccccatactatcctgggtacgttctcatcatctatttgatcgtaaaattttaagttaaaattatttttttttctttactgatgttcttattgcattatgtaatacagattcgatagagacctcaaatggagaactggggcggagattgtaccaatacattgctcaagttcaaacggattcagaattacagaatccgctcttgaagaagcttatctagacgcaaaaaagcgcaaccttaaagtgaaaggtgttctagtgaccaacccttcaaatccattgggaacaacactaaacagaaacgagcttgaacttcttcttacattcatcgacgaaaaaggcattcacctcatcagtgacgagatctattcagggactgtttttaactcaccaggcttcgttagtgtcatggaagttctaattgaaaagaactacatgaaaacccgagtttgggaacgagttcacattgtttacagtctctcaaaagatctcggtctccccggttttcgcattggtgcaatctattccaacgatgagatggttgtctccgcggccacaaaaatgtctagtttcggattagtctcttctcaaactcagtaccttctttcatgcatgctctccgacaaaaaattcacaaagaaatacatctctgaaaatcagaagaggctaaagaaacgacatgcaatgcttgttaaaggtcttaaaagtgctggtattaactgccttgaaagcaatgctggtttgttttgttgggtagacatgcgacatctactaagttccaataattttgacgctgaaatggacttatggaagaaaatagtgtacgatgttggcctaaacatttctcctggatcatcatgccattgtaccgaaccaggctggttccgtgtatgttttgctaacatgtccgaagatacgttagacttagccatgcgacgtataaaggattttgtcgagtccactgctcccaacgcaactaatcaccagaatcaacaacaatctaacgcaaattcaaagaagaagtcattctccaagtgggtttttcgactatcgttcaatgaccgtcaaagagaacgatagtcctgcaagtgtgaacattcccttgtccacaaatccagattattttttttctcaatattcacatattgagttcaccaaatatttttttgtatgattaaaatactttactttttttaaaaaaaaatgttagagggtgcactctgtccatgtgatggacgagcagtggtttttcatattttttatgtaattaacatcttgaagattggatatctgcaccaaatcttcttgaaatgttcaaactactacattatatcagaaatctttcttggtatgttcattatttacatcacatgatgagtatattgatatttcaacatgctattttaattttgatacattctattacatttattgtagattcctcatgttatgataatacacaaaataatactagcaattacatggtagaggcggaattaacgggaaaacaacgtgtcctatcatgcctaacattggacgttggccggtttctttacttgccaatattattttatttcatcaaccgactttttatcctattggcatttggagatatatacgtagaatatggaggataaaaatacgacattgttcaatacgtaaaagcagcattctcgttggtgggtccaaagtagaaataatagtcagaagacaaatgtgttttttattctacttctgaggtttctaagatcattctttttctgggtgttgcaatgagataacactaaacttgcctgtattcttggacaaaaaaagattaaaaagaagcgatagagaaagagttgaaaaaaaagaaatagattgcttgcaagtaattgcaaagtttttaagattttgttattttcttttttctactagtattagtactattttattttttgtatatttgagtgttgttgttaatgactacacccacctgccactcgtctattttcagtggatatgtgtttttcttttgcacgccttttaaaatatagtaagtattactttcttgtaaaataaaaaaaatatattataaact

SEQ ID NO: 271 - DNA, 4843 bp, Solanum lycopersicum
  modified_base (1)..(89): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttaataattcaaaatatttaaaaaatattcggaaaaaaatcgtgagtccctttgactctctaaattgtaattagctaagacacaaaaattaaaaccgaggtgagtactaaatgaaaaagaaaaattaaattattttttatataattgaacaaaaaaggatttattttttatcttgaatattattgtttttggtactataatcatttggtatacaaaatttattagattttcttttgtagaaaagagacaatatattattgattaatatgaatcaatagacgtggcgatgtgttgctagtactattaggggatggggatgttaatacaaagttcgtactacaataattatattagtagacatatatggcctttttttgattgatttgactaatttaaattagaatagcgtagaattcatataagtaaaagtaattctaatcaataacttttttataaaattaaaatttgaaatatctagttaaagatatgtactgaaatttgaatatgttttaactttttaaatattttgacgtaagttttttgttttcccccaaaagtttcacattagactaaatttaatttcctataacttagtttctaatattttcgacgggttgaaagcgtcataaatgactaaatctttttcttaaaagagcgtaaattctgccatgttttaatctcggtcttccacttttttcatgccataaaagattaaaatctttttcttggaagagcgtagattttgactttattttaatcccaatttcttactctttcgatgaggcaagcataacctcaccacactacactacactttggacacaaagcatttcttcaattctccttagctataaaaacccctcatagcttcttcattctcttccaaacaaaaacttttgtacttcaaatttcactaggctattaaactaaattcataaaaattaggaaataataaaatggatttggagacgagtgagatttcaaattacaagtcatcagcagttttgtctaagttggctagtaacgaacaacatggtgaaaactcaccatattttgatgggtggaaagcatacgataacgaccctttccacttggtgaataatttgaatggggttattcagatgggtctcgcggaaaatcagctttcagttgacttgattgaagaatggattaagagaaatccaaaagcttccatttgtacaaatgatggaattgaatctttcaggagaattgccaactttcaagattatcatggattgcctgaattcacaaatgtaagttttgttatttctctcctttcaaaaacaaaatgtcacattaaaaattagtatacttttttaattatcctccgttcaattcttaagaaatatctaataaataaaaggattattcttcttaataggcgtgaaataaattaaacttagacttcttttaagatgaatatgaaatacttactactattatatatgaattgtagcggtgaaagtcattatgaatttgtacaaaaaaaaagaaagttaatgatcaattttattactataattttacattcacttggaataaagaactaagattacatttagttagttgaaatagatatatttcttgacttctatctcatacatatatttcattttatctgacactatttttacttgtttattgaaaatttaaaaaattacatacgttattaaaataaatatatttttatccaattttttcgtataaaaaaatatttttttttgtgtaggcgattgcaaaatttatggagaaaacaagaggtggtaaggttaagtttgacgctaaacgtgtagtaatggctggtggagctactggagctaatgagactctcatactttgtttggctgatcctggtgatgcttttttagtccccacaccctattacccagggtatgtatacatatttctaaattgaattcaacttatattatatcgatcgtgaaaaaaatagatgtttcttaattaaatattaaattccttcttgcctatttaaaatgcgaattatattatatcactcagttgacctttaaaatcgatattatataatataatttgtatttttcaaattgaataagtgaaaatagtcatttaatttatttagtagataagtaaaaatggacggacgaagtatataaataccatttcaggtaattgattgaggggagatttttttttaatgaaataacacttagtaatttaagagagactatccgtaatggtcaaatctttagaactaatattaatgggggcaacttttcctacttgtgatttgtcaaaaaagttgaaaactaacaaacaaatgatatttttggttctctgtctttttattttgattaaaaaaaatgaaattttctcatttttttaaaaaaataatggatagtataaaaattataattactttctttatcctgatttatgtaacatagtttgaatttctagacgtttcaagtttaattctgaatttgtatcatataaaaagtatttatttattttaaaatcgttatgattaataattcaaatgaaaaaattgattgactctcgaaatttgtgattatacaatgataaaattatttaatggcttacattggcatgtatttaagtcttcatttgtattaaatgcagatttaatagggacctaaggtggagaagtggtgtacaacttttaccaatttcatgcaagagttgcaataatttcaaaattacaatagaagctatcgaagaggcctatgaaaaaggtcaacaagcaaatgtcaaaatcaaaggcttgattttgaccaacccttgtaatccattaggtaccattttagatagggacacacttaaaaaaatctccactttcactaacgaacataatatccatcttgtttgcgacgaaatatatgctgctaccgtattcaatcctccaaaattcgttagcatcgctgaaattatcaacgaagataattgtatcaataaagatttagtacacattgtgtctagtctttccaaggacttaggttttccaggatttcgagtgggaattgtgtactcgttcaacgatgatgttgttaactgtgctagaaaaatgtcgagttttggtcttgtttcgactcagacacaacatttgctagctttcatgttgtctgacgatgaatttgtggaagaatttcttattgaaagcgcgaaaaggttgagagaaaggtacgagaaattcactagaggacttgaagaaataggaatcaagtgcttagaaagcaatgcaggggtttattgttggatggatttgcggtcattgttgaaagaagcaacactagatgctgagatgtcactttggaaactcatcataaacgaagttaagctcaacgtctcccctggatcttcgttcaattgctcggaggtaggatggtttcgagtttgttttgcaaatatcgatgatcaaacaatggagatcgcacttgcaaggattcggatgtttatggatgcttacaacaatgttaataaaaatggagtcatgaagaacaagcacaatggaagaggaacaacctacgacttaactcctcaaatggggagtacgatgaaaatgttattagcttaaatatcatgtctcctaattctccaattccttgctcgtagtgcgagcaaacaaaattattgttgtacaatcaaataaagttataaagcttgtaaataaactagattcgcccaggctcgtgctaaagcacgggcccaacatagttaattttagtgtcctaacacaaccaaattaattttatgttgattttagtgtcgcctatttcatcgcaacaatataaccgaatcaatttaactatatgggtagaatatgacattgtcatatacccgtacgaaaacataagttcatatacctttaaataatattgatcattttgtttaaaataagctacgtatcacaaatacatgattgggtaagtgataatacacaaatacatgcttggataagtgatgataagtgcaaacaaccactccatgtctataaacattatagacagagagaccagtaaatgtcttgtaggtgatatattgctatcttattcacattctcgagtcctatatcatcaataaactcacttcataaataatcaatattagtgaatttgaaagaacacatacaagtttctcaacaaaagaagatgtcatacaagtatcactaaaattatccttacaacgctcatttaactctaagaggtgcaaacatcaattaaaaactaattcatacatcaccttttattatataattatctgataatatgaatgttggtctaaataagatttaggagaaacacatgattattgaaatacattttttatatatagctaaacttattcaagccatggtaccccgaaatataagggatgacattcaaatttgatacatgtgagagttaacacatggatgacacaaacatacttgttcagtttctacaactgtgcctgaatttccttagttttcatcagcttcctatttgtagcagtacttcataatggtctcttccttggagaatgtcataacaaacccaacaacaccaactactaccatttgaccatccatctcacatgtttttctcttgtggagttttacagttcaacaaataagatgtcaaaatgattttttagcatcaacatagtagtatctccccttggaatgaaaggtagttggagaactctagcaacctcgagtccaaataataaatgtatgtcaaaattgtgaatac

SEQ ID NO: 272 - DNA, 7815 bp, Solanum lycopersicum
tgatgatcccaaaaataaaagaaagaagtaaaatagacaagaaaatggaaaggtagaaaaagatgaaagtaaaatttgttgtatttgtcattgagcacataagaggtccatatagacaaatttattggccttgttaccaaagaaacaagtaactttttgacatgatggtataacttgatataagtggttgtttcatacaagagtttcaatggaaaagaaactggagtcacatgccagtcaccttctcttttgtcatacctagtttcactaatctagtcattttcttttcttttatcccctctcaatgatctagtttaagtctcagtttatatgggagagtaaataaaatcacaaagtaatatgtacatttaggggtagggaagtcatcatgtagaagaaaagtagcgatattggtgggggggggggggagatttccaatcgatcacatacgaattcaatcagactcaatattcttaacaagaaacacaaatgtgaattatcaaactttgaaaaacattagattctgaatgtattacgaatttagtcttattgaagttatcaatttcaaattttggatctgtctatgatagtgagagtaaatgcaaggggaggagggatggggggattgttatgggatggagaggtggagtttacatatagaaatcaataattaagagatttggaaaacattttaacctcttttggttcaaatctttcttattgaggtttctttaaaaggtctaatccaaaatttgggaagcatttaagcttgagtgtaacctattccaaatttccaatgttctcttcacccatcaaacatcactgtcactttcaagggtcattttctactctgtccacttcctccccccacccaaccccacccccacccccaccccatccctcacccaaaattctcttatgaataaaaagacaaatttttacaacttaatgacctaaattagaaacttaaacaagagatgaagaaaaatgaaaaatgtccaagaaatgagtgatcatccatcctctcattagataattcccaatttaaccatccttctatatagtgcttattcaaaacaaagataacataggaataaacagacaatgaaaaatcttagtttagataattagtagtagtaacataacataacatagttgttatatatatatatatatatataatataaaaataaaagtaaacactcttttactttataaatacctatcccttagtccaaagtctcttccattttctgcatctacaaaatcctcttcatatattatatactaatttgcaaccaaaaaacttaaaaatcttctctttcctttccttacaaggttagtcatcaattttaaaaccatttcttggattcatataactaaatatcatatggggttagggattctttttctttttgtctatgtagaacaaaaagttcaaatcttgatcaatttttttttttgtgatgtaggtgaagtaatggacttccaaagtgatctaaccagagagatctcaccacaaaggaaactaggaagggggaaaattgagatcaaaaggatcgaaaacacgacgaatcgacaagtaacattctgcaagaggcgcaatggtttgcttaaaaaggcttatgaattgtctgtgctctgtgatgctgaggttgctttggttgtcttctcaaacagaggcagactctatgagtatgccaacaacaggtaaattaattaaatttctaatcttttataattaagtaattaatacctctactatagtacatttttttttttaaaaaaaaaatattatttatatttgaaggtgaagaagggtgtttcttgtttttttttatgtcatttgtctttcttaaaaaagagaatttttgatttagttttggaaagtttgaatcttttatacatcttatgatgatacataaatgttaagggagatctaaacttaactactatagttgtgaagttttttttaattaaatacttttgagcaaagattgactttcctttctttttgtgttaatatttttgttacaattttggtctatttgagggtagtttttttttaattttttatgatcccattttgttgatagacatgtaagatgtatagatctgtttgttgtaagaaaataagtggaaattttgagaaagtactctcatcagaactcttagatcagcatatactttcttcctccatgctcataaaaaaaaattaaaaaaaaactcttcacacacacaaaatgaagggaaaaaaaaaggtgtcaaattttaattggctataacataaaaattcattaattcttgttttgtgataagattaatatgacatgtatccaatcaaaaacaagattagggttttgtacttcattcactactaataatatcagtgaaagaagtactcttttttgtcatgagtcaaacttgccctaattagggttttttaaacttattttatgctataaaaaaaattattactattttattttatttttgcttctaagtttatatttgcctttcttataatcaaaatatcagatatggtagaaaaaattaaccaatcagagtttaaaaagatttcaataatagacaaaagttgacattcttcttcacttgctatttgttgaaatgttttacaccatttaggtaatggggtcatcaacactctacctttttatttttttttacaaaaaattgttacatgtgagagtggttggtataagtttttttttttttaattctcagttacaagaatctttggtcacgtcatacaagattttacacttgttgacaaatttgatgagaaaagacacattatagtaaattaaaggaatggtattaatttccttctttgatttctcttttaatttccaactctaatggtgaaaactcacaaacacaaaattaattatttttggtttgagatatctcagtttaatgctttcacaaaggttctgtaaatgtttgaacttaaacagcaaagaaacagaagttgtaagaaaagagaaattgtaaaccaatcaaatattttttactcaaactagggtacacttattagctatgttatatcaaatacaccaagaggatcttattcatagatataattacgtaactttttttatttcaaaaacaaaaaagttacttgtagttttttttttaaaaaaaactttctattattttctgacaactctttaattttaatttttcatgtgcacgtcaccactagccactaccagaaaacatggactttatgcgtaatcttcatttaattgacgttaaaaagcttctagttgattgattcttcttacaaaccgtcgtttatctgaagctaaatgaaattaactgttcgtagctaatttcttgttttctaatactgtatgtgtttaaaaattacaagattaaataatattattggtacatttgacattattttaacttaagaccacacaatttaagtcattttctaattttattttttttagaaaatggtatatcaagttaacatcagacaaacaaataaaaacgagtgaaacagtaacagggacagagctagatggaggtttttgattcagacgaactgagtagcttctctgtataccacatatttatactagaaaattcagtacataacttgtgtatccctaataagacggattgataactcaatgataaagaaacggaatgaaatttagaatcggaaactcctaatattgattccgcatctgtcctctcgatagtaaatgtatgatagggatgagagatagggtgagggtacaagttttaattgtgaaccaatgagagaattctgctgaaaatatgagacagacagacaagactctatcaaactattcactttaccttacaataaggattgaaacaaaaccctaggtgggtaaaaagctatagttgatgggtattacccaaggaataaactgtaattatgacgtggcaataatctgaaccgttgaaagactggaccaatcatgttgtgggaaattgtgccaggttggcagagagcagccaatcagtagctcggggaaattaaggtagtatagcagagtcattccctcaatgtttggttttttatatatattttgtttcttcagtcttaggtctaaaatttatatactactagaaaatattgtatcaaatgtcatgtttgagtggacacattgagtttctgactcgaaccaacactatttttaaaaaataaaaatcaagtttgcgtgttggcataaattagcatgaaataaataataaagtatttggattttctttaccttttaaacaaaagggaggcttttttttaaaaaaataattattattattattttcaaggtgaaagggagtaagagaagtaaatatgacgtatgttttataaaaaaaaatttagcaggtttaccatcgatgtttgatatctattttgagggcagatatatttgagtgcgtgttggaaattccactttgggaggaaaaacacttttttatcgaagatagactcaatatacaggactgatcgaaattgaaacttttgattaagtatgattgagtgttttaaaattatatgtaaatctaaataattcaaaacgagtaactaacatccttatttcttagtacgtagttagttgcatagaaaaatccatattttcttgtctttcatgtgagggacttttatgtgtcctcacttaaattttgattttgatttgattgccatgaaagatttagtgatcttatatatggtctatggactcttaattatgaccatctaattttatagtcatatagagtagtaatttgtatataatatatatatatatatatatatatatatatttgtatgtgattttgtctgtcaatagactagtttttttatgattgaaaagaagctatcaatctaacatgttgatggtgtagtgtgaaagcaacaatcgagaggtacaagaaagcatgctcagattcctcaaacactggttcagtatccgaggccaatgctcaggtatatataatttcatacactgcaaatattctctttttttttattactaggattacactggatatatcgttgaaatattcttctttcttttgttgtaataacggatcaatactattttgggcaactattataaaacttagaaaagaagtcattaattagcactctcttcgtcttcatttatgggagtttcgagttttaaacttataaactttgacaatgaattgcaacatacattagagatgcataggttttcaagtcttgtgggcggagtttgagggggtaaagagggttcatctgaatcccttttgccaaaagtaacattaacaccttagtgtttttgttattatattgcacatatatagatatataggtgttctatttaacaatatgtggcatacattacaagttagcgctcttgtggtaactgtaaataaaaatgttgttcaatgaatcccagtattaccagcaagaagcctccaaactgcgcgcacaaattggaaatctgatgaaccaaaacaggtgaagtttttaaaatcttctttatctttaccttttaacaattccatgtgtgtgtttttactatgttgttttcagtttaaccttaactgcattggttcaggaacatgatgggtgaagctcttgctggaatgaaactcaaagaactgaagaatctggagcaaagaattgaaaaagggattagcaaaatccgatccaaaaaggtatttaaattagtaacattttctaacaactatttagtacgatgatggtatgaaatgagattaaatgaaataattcatatagcaaaccctaacttatttgggactgagacgttagctattgttttgacgaaaattacaatttctagtttcttaacatttgacgctcaaattacagaatgagctgttgtttgctgaaattgagtatatgcagaagagggtaagtcatagtacaatctttcatatacttagttttcatttcaagttaatcgatctatttttcggtcataatgttttctatttcatgtcaaatttgtaacttaatggacaccagcaggaagttgatttacacaacaacaatcagtacctgagagcaaaggtctatttgtttctctatctagtactattgtagttgacttttaagtgcatctgaaatacccatagtcgtctatttacattcttgcactcaataatcaatcaattcgtttaagtactaatttaatacgcagaaactcattggttttgtttttgtgagtaaatttaaacagattgctgaaactgagagagctcagcatcagcatcagcagatgaacttgatgccagggagttcatcaaactatcatgagcttgtgcctccacctcagcaattcgatactcgaaactatctacaagttaatggattgcaaaccaacaaccattaccctagacaagaccaaccccctattcaactagtgtgagttttcctctcttttctaatataaacatggtgctaagtcaaactaagacataaaatgaagcggtattaaaggtatgtcttttttttcttatttgttgaacagctaatgtgcttgagagattgtcttctttctgatgtgatctacatataatccacaaaagaagactgctattaagcttgaagattaatggaacttaagtatgtataccatattattaattacttgttgcatgagctaagactcttgaatattgtatgttaattaagtggacatgtattttttttgcttggtgtacttccttttctgccagtgaactatgaagaattaagcttgttatattaagttcacaactgtttttctgtccaactatgttgctctttttcttttgtgcatatttggatcacttcacattcagcttcatattatacaaagtattcttacctcacaacagacaaatattccttcggggcggagccacattattaggtatgagttctcatgaataacagttacttttgttttcacaccccgtgtttggtaccctacccaaagattttgttagtcaagcttgaattcgagatctctgctaaaggaaatgacagtcgatacgttgcttttggttagacatgtatgtgtattaggaaatctatatagttgaaaattcaccaattgatattcctacagcaaaaaatccatattagttgagtgttaatttcatatatttgtggtgaacttgtcttcattaaaatatcattttcatcattaaaatccatcaaaaggacccaaattggttgataaattctttagtccttcatgatgaattcatattctttatgagaatcagctatatgtaagtcctcttgaataagtttttgagatatcttcacaaagatgtgggctttaatactggaccataaatgggcttattacacaattttgaactgcacatttgaaactacacatgtatagaactcacaagttatgtgcaaagcaatgaagttgagatctaattgagaattttgactcatatttgaaagatcaattacatcaaacaagatggataagctatatacatgcctaatcccgggattagttttgatagggataaaaactcagaatatgggaatgtagtgttacttttatcccatgttgagggtggaatgacttatctccggataacttgaaccctaactaaacaagccctaaagtctatattatttagagctgagccaactgactaatgtcaaaaggatagacatgagtggattgaagagcagtgtaagctctttcagcagtgaccttatttggagcttctgaggggtgaaaaccatcccaaaaataatgtgctgctctatcactgcatgca

SEQ ID NO: 273 - DNA, 9265 bp, Solanum lycopersicum
cattggttcaccatttagttggttggggcacatctaatttatttgactataatatcattgttttagggtgtattgattctcgatttaattaattacaccgtatctattttatgggctcaaatatcaccattttagggtgcattgtttttccacttaattggttggggtgcaccgaatttaatttctcggttcaaatatcacggctttagggtgcatttgttttccatttacttggttcgggtggcactaaatctaatttcttggctcaatatcttctagttatgttaattagtttttcttttattgttatcttcttacttatagatcttcaattatatcgtgtcttcacgtcaaaaaatataaataattagagcaacctgttaaatttataatatagttgactctaacttcagtacaatattaccgactaacatatagccaaatcaaaatttgagaattcaatatttaatatcatcttttaactatagattatcgaaatcaaagtttaaaaattttatatttaatatctatatttactatcgattatcgaatatgagattagctaaaatataccatacttaataacaacctaataaaaatagtaatatgctctaataacttaatactccatcaatcccacacacaataccgattgaaaaaaaatccaaacaaaatatatttacagtaaatcaaataaaataaagcaaaacaacaaatacgaaaaaacaaaataaagctacaatagagtattattattataactcctcgtttgctaaaccctattaatttaattataattaattaaagaatgcatttaatatgattaataatccacatcatcatccagcttgttacaagccagtcaacgtccgtgatatgtccacatcagcatccgagctggactcgcgtccaaacaaaaaggacatagtaggggctaagttgtcattttcaacgacctacccttgctatataacacacagtctcaccacaatattcatttgtttatagattttctctctctacaaatcacagtcttcacccctcactccttttctctctctagctctctctcagtactttttctgccgtttttttttctattaattttctgtgtacgttttgggtgctgtggtttactggagagaacggaatttggcttttacggcggcgacgtcttttgaggtaacgatcggattagggtttttaggttttactgtttgcttttctgtttctgctgttaggttacttctgtttgtgtttgtgcttagtttgtggtgttttggttggatagatctgttctcgttgtgtatttgggttagttttttcgtcgatccggggtttttgttgtgagttttactcggtgagtttttcattgctgctgttgttgttgagtttgcttcatgatcagatcttttaggttttcacgtttagtcgctagcgttgctgtttgtgtttttacaaatgtatttaagttttaggttagagatagggtgaactttttgctagttttttttatttccttttttgtacacttcgtgtttttgatagacatgtatgtagcttctttaggttttgatgttggtattttttttgttaggaggacattggttgtataggcattaaagttttgaagatatgtggttgctctctgtttaacatgattaaatgttgttttcgatcattgttgtttgatatctgtaggtgataagatggcgaggaagaggagaagtgagttacctggttcaggtgagagctctgggtctcaagaaactgttgggggacagggtcgtggccagtatccaccccagcagcaacaagaaggtggataccaaggtggaggacagggtcgtggcatgcgtccaccaccacagcatcaacaacaattaggtggctaccaaggtggagggcagggtcgtggccagcgtccaccccagcagcatcaacatgaaggtggctaccaaggtggaggacagggtcgcggcatgcgtcctcctccccagcagtcacaacaagaaggtggctaccaaggtggtggacagggtcgtggccagcgtccaccacagcagctacaacaagaaggtggttaccaaggtggaggaagaggttggaggccacaacagggagggtatggtggccgtggtagtggaggagctccacgtggtggaatggcccctcaacagccatatggtggacaggctgaatactatcagcagggcagagggactcagcagcatcaacaacgaggtggaggaccactccagcaacatggtggcataggtggccgtggagcaccttctggtgggccttctaggccaccaattcccgagctgcaccaagcaaccacacagactcaacatcaagctgtaatgactactcagcccattacttgtggaagaccagctgacacatccatggaagtgggttcctcatctgagccacctgagatgtcagctctgcaagtgacacaacagttccagcaactggctgtgcagccagaagcagctgcaacccatacaattccacctgtgtcaagcaaatcactaaggtttccgctgcgtccagggaagggaaagtttggtcagagttgcatagtgaaagccaatcacttctttgctgagctgcctgacaaagacttgcatcagtatgatgtgagtgctctaactttgtattgtattgttctatcatggtatattttgtattgtcccaatgttttttcatttgtttggggttatgggtcctgtggtttgtcatatctattgttaatcattattcaggtcaccattactccagaagtatcttcacgaggggtcaaccgtgctgtcatggcacagctggtgcttctttaccaagaatctcatcttggaaagagacttccagcttatgatggaagaaaaagtctatacactgcagggccccttccatttgttcaaaaagagttcaaaatcactcttactgatgatgaggatgggcctggtggtgccaggtatgtatggctgctgtgtcaactagttgcttgttcagtttctagcaaatctgatgtttgcctttttggttatttattggaacaggagggatagggaattcaaagttgtgatcaaattcgcttcccgagccgatcttcatcacttagggatgtttttagaagggaggcaggctgatgcaccccaggaggcgctgcaggttctggatattgtgctgcgtgagttgccaacatctaagtatgttcttttttaatgcaatacatgtttctgtagttttggttcattgtcatgatgatgtacagagaaatgtttacttgtgaatatcatttttatatatttcgatactttgttggatgtcaggtattgtccagtaggtcgttctttctattctcctaatttagggagacgacaaccattgggagagggtttagagagctggcggggtttctatcaaagtattcgccctacacaaatgggattatcattgaacatcggtatgtggagtcttgactttttctggagctgagttgttttctattttctttgaaattttacttctgaaaatgccctacagcttttataataatcatatgtttgatcttgtgcatcaatgtacagacatgtcttccacttccttcattgagccattgctggtcgttgattttgtggcacagcttctgaaccgggatgtgtcatctagaccactgtctgatgctgaccgtgtaaaggtgaacttttgtatttttttgttagtagaatgttctgaagttctgattattgttttgatgtttgtcttccttttcatctagttatagcttgttccaggttgtgttgtgttacgttggtcatgcttcgtgattaatgttttttatccgacattgtaattaatgatgttgagctgagctgcagatcaaaaaagcactgagaggtgtgaaggtggaggttactcatcgtggaaatatgcggcggaagtaccgcatcgccaatttaacatctcaagcaacaagagagttaacgtatgtgggcttagttttagttttttgataactgttgtataaagtcatattatgtgtagctgcaagcagtggtgtttctgcattctgcctttctataagatcatcttcgatttttcttggtgctgatccttgtttttttctttgttttatcctttgttttgtggtagtttccctgttgatgaaaagggcactttgaaatctgtaattgaatattttcgagaaacttatgggtttgttattcagcatacccagtggccttgtctgcaagttggaaatcagcagagacctaattacttaccaatggaagttagtgcctctctctctgaaaactagccatctttgattatattatcaattcttcaagctaaacatatatcatggtgcaggtctgcaagattgtagagggacaaaggtactcaaagcgcttgaatgagaaacagataactgcacttctgaaagtgacctgccagcgcccccaagaaagggagcgtgatattcttgaggttagatctttgcctcttttgtttatttatatgtttgtggaacatttatttggattgtggtgtagttgagtaattgattgtctgctttatattttgatatatattcttcggtgactgatgtgtgtttaaattaattgttattggtgcttggtattctgtttctatgttgctgacttcatgttaattggtgtatttgttctggtatgaaatgcatgttggtttgtatgtttttaggagtgatataatgcgtcaatatgatgagttggtggaaaaaagagaacttgactatgagtatctaatatacttttgtgatttatagctgcacgggtggttatgtagttgaggaatttaatgtcctgttgtttcgttcttattatctatgtgataaataatgttagatctcctttaggctacgcatttgtcatgatcgtcgaaagaagatttctttaaggccattgaatcgtcatatgttgtgttagagcttggaaaataatttctgatcgctgtgtcttggtttattacgaaaatttataatcagttcatgacaataatatgtttgtgatgaaaattcacttctatttattttcctttctctgtcagactgtgaagcataatgcctatgctgaggacaaatatgcgaaggagtttggcattaagattagcgacaagttggcacaagttgaggctcgtattttgcctccaccttgggtaagttaggctcttcatggtttgagggggggggatggttttacaacccctggacataccattctttctacagttcaatttgtggagtggaggagtttcagttaggattggataatgagtgtgtattttctgcagcttaaatatcacgataatggccgagaaaaagattgtctgccacaagttggccaatggaacatgatgaacaaggtaggtgctgcttttgacacgttttaacttttctgtcttttgttttgttttagtttctattcagttaatttgcatctattggtgtgcatcagtagaaaacctgtgttgtattttgcttttatcaattttattcaatgaaaacaccagatgtatattttcaagtatacactattctggcggttgtcgtgaggctgtttttctttgttttgctatgcctaaaatagtatcccttacttactactgacagaaaatggttaatggaggaactgttgccaattggatctgcataaacttttctcgcaatgtgcaagacactgttgcacatgggttttgttctgagcttgcacaaatgtgtggaatatctggaatggtaagtacgcatgttgcagcccttttttttctttgtatgtactcggtctttaacttaatatttgatgttttttagaacttcaacccgaatcctgttctgcctcctgtaagtgcacgccctgatcaggttgagagagttttgaaaactcgatttcatgatgccatgacaaagctgcagccgctatcgaaggagcttgatctcctggtcgctatcttgccagacaataatggctctctttatggtataaaggagatagacatcttatgttctatagcagaatattggattatgcagtggctgaaattttttattcttgaccaggtgatctgaaacggatttgtgagactgaccttggagttgtttcacagtgctgtttgacaaaacatgtatttaagatgagcaaacagtatctagccaatgtagcactgaaaattaatgttaaggtgggaggaagaaacactgtgctagttgatgcaatatctaggcgaattccccttgtcagcgaccgtcctacaatcatttttggtgcagatgtcacccatccccaccctggagaggactctagcccatccattgctgcggtaggatggttgaacactttgattttcagtgtgttgaccaaatcttttgaggaatgtgaaataatttgtctttgcaggtggttgcttctcaagattggcctgagattactaagtatgctggtctagtttctgctcaagcccataggcaagagcttattcaggatctgtacacaactaggcaagatcctgttaaagggactgtgtccggcggcatgattaagtatgataattttattgctttattttttctaatatttctgtttacctgagtttttagctgtttgtgtctccctttggtttttgcgggaggatcaaattcgttttatgatattctaacttttcgtcttcatgttttcttatttctgattattcagggacttacttatctccttccgaagagctactgggcaaaaacctcagagaatcattttctacaggtattgtgatatattgccctgacaagtgcagtatgaattacttctcctttggcttaacttattactttctccttcagggatggtgttagtgaagggcaattttatcaagttcttctttatgaacttgatgccatacgtaaggtatgttcctttttgttattgatactagtctttttcttagttctagatgttgctcatttccttttttctacttttatctctaacaagtattgaattgacttgagctgaatctcaggcatgtgcatcattggagccaaattatcagcctccagttacatttgttgtggttcagaaacgtcatcatactagactttttgctaacaaccaccgtgatagaaatgctgttgatcggagcgggaacattatacctggtaattgtttttctaacttcctactttggacatcttgtacttgattttgaatcttattttgaaaacataaccgtacaggtactgttgttgattcgaagatttgccacccaacagagtttgatttctatctttgtagtcatgctggcatacaggtgaaagttttgtatcatgtttgaccatgatgtggtcgaagtctaggcgagctgtagtgtaacagatgttttgattctgtagggtacgagtcgtccagctcattaccatgttctatgggacgagaacaagttttcagctgatggactgcagtcattgacaaacaacctgtgctatacgtaagtgtacttctgaatttaccaggtttgttctggaaatgttcctactcaactcatactgattctcttcatgtgttcctctttttagatatgcaaggtgcacacgctcagtctccattggtatgcccttgcacttgtttatagatttctagccagtttatttttagtctcctttttttatttacttctcccagcaatgacttgtttgtctttagtgaataatatagttttattcctgtcagtccctccggcctattatgcacatttggcagcttttcgtgctcgtttctatatggagcctgagacatcagacggtggatcagtaacaagcggagctgctggcagaggggttggtgcaggagctgctggaaagaatacacgagcaccaggtgcaggttctgctgttagacctcttcctgctctcaaggataacgtgaagagggtcatgttctattgctagagtctcaacaaacaaaagcttcattgaagacttcatttggcgcatgcccttttggtttttgtgttttgcgatcaaacaaaattttatctggttcgacttgccctaatatttgtgacattgatgccagaaaactatttagagtttgtagtattgcgcattattataactgttgggagcattccggtgttcttcatagcctgtgtaatgatgaatactatgcaaatttatgcttgtttttaatatggtccaatttgggtcgtactttcatgtacgactttacttcagctgttcagtccccccttccttccaactgaatattaaatgatgttgtgataacttatgaatctaagtgttctgatcatcgagtttaactattttacgatgttcgtggaattatataggtggatctagtgggtgctttcgttttggcttccaatactctattgttttgttctttaactgttgtttcagctctagtttcaactgcaatataaaactcaaacatattaatatcactgttatacctagtaagacttgagatatggcatacgctaggccactacgtgaaagagaagagtaggtggcaggtgaaggtttgtacgtaaactaggaaaagaataaatctcagcaaagacaagtcgatgaaaaaaggaaatattggacaaaaccaaaagatttgatgttatacgaagagggaattctttacttattgtctccatctttcttcttgccacttttggcaccatggaatctctttttcttggcttctacactccctaattggctcatatcatattcccttttccatgtgttttactttctcttttcattcaaccctttccttatataaagcattttgcaaccatcatttgtcacaactcaaagcatcaaggacccccacagcaagtttcaacctactttcttcgttgaacttgaaatcataatggctactacaccagtcgctgatagcatgcctgatgctttgaaacaaagccgatatcatatgaagagatgtttcgctaggtgaccacccccttcttgttcctttttctgcactctatgcgtttatgccgaatgctaactagtttgttattttttttcttcttcattggatgtcaaaggttcattgctacgggaagtaggctgatgaaattgaaatatttaatggaagatatagaaaatactattgaagacaaggcagaaagaaccaaggtcttggaaggttcacttggacaaactctgagttccacacaggtcagcaccattcaccaacataattga

SEQ ID NO: 274 - DNA, 6065 bp, Solanum lycopersicum
ttattttttattttactcgtcgctaatttatatttaaaaaggcaaaattagcataaaatatataagtttacgaaaaattaagagcttttgcataaactcttttctccccctccctctttatatataaattaactcataaaattcaatttttctttcaatcctattcctagttattctatatgtaaaagttgtgtcattctgaaatatatgagttcacgaaaaatcaaaatatatcatatttcaacttgagactattgtaaggtattcattaacatcacatttaattggagttaattatgtttcattatggaattttaaaaaaaaagttattttgataatgaagattgaagttgtatttgatgtaaacaaatattaatttgagttgtgttttacattttgtgagtaatttataatgtgaaaagcagaaacacctttttattatttttggggaaaaggtttagaagtatattcaaactagaattaaaattgttgtgacaatcttaaactttgagcagaattcattacgcctctattatttaatagtgtatttcaaagctgaataaattactagttataatgatgcagtatttataatatacacatgaatatctatatatctttaaaatatactattaagcagtagaatgagtaataggtcctacacaaagttgagaattgttataacaatttcgatcaaaatttaattacatttcaaatcttttttccattatttttcaatcaagaccgaacatactttccaaaattaatatgcccctcattatacatacgagggcatatcaattccaaatgacaaactgatcatatatttgacccttttttttttggccaaataccctcataaatagctctttgtcctcctactcaccctctcctctcccccccctcccccttgtctgtgcagccagcaataacaactgctctactgatagtactgaaagtattctttatatatctctgagtattcttttctttcctttcactctctcatgcacaaaaaccctttcttttctatttcaaacaacaagttatggaacatactgaaaactccaacaaatgcaactctaaatcaacaactgccaaaatatgtccaaataacaacaacaacaacaacaataatcactatattgcttttggttttcatcacaatactaataataatcaatatcatgaaacttaccctcctcttctccctttacctcctctactacctcctcttcaactaccttttcctcaaaatcacaacttcagatcaagaacccatctccataaaccttcatttaaccagaatcatccttttcttgccaccccttctgatttcaagattcaacaaatctcaggtaatcaagaattgagaaccccttttacttcttttaacacttttatgaaaaaagattggatttttatgtagagagtttaattagagtctttttggtattcagtttatgtatatgataaaaaaaaagattaccttttttttctgcagaaagttgaggattggcgtttaattaagacttcttttttagtatatggtaaaaagcatgataacagtaaccttctgttagttcttttattagtttaagtattaagtacctttttctttttgtcatgttctgtttgttcaaagtttattgtcaagattgaagctttaatttatgacatcaatattgtgcttttgatattgtatctgtagtctctctatgtcaaatgcagaaaaaagaatcagtttttttttctgcagaaagtagaaagattaggcttcttttttactataatatatgctaaagcatgagaacaatagtctactgttacttctttattagtggagtacaacttttcatcatgttttgttttgttcattgtttgttgtcttcatttaatccactagttgatatcctttagttagagtattaatggaactatgttgctcgaactctcgaaaatgttctcgtacctatgttagatcctctagaattacactacttttgaacgatccaacatgcacccgttgatgttaaagacttcattacattaacattgtgcttgatgtgtttttttgcttttgatgtcacttactaaacagcctcaaaggtgctccaaaggcaaaatgatgtgtccaaacagaaatatggaaggagggtcagggctgctgcaaccaccacagaatctgttgtggtggcaagaagaccagattctggtggtgttgaaggaccagtaatatcacttcttgctaatcatttccttgtccagtttgatccttcacagagaatattccattatgatgttgaaatttcacctcatccatcgaaggatattgctaggctaatcaagaaaaaacttgtggaggaccattctgttatgctatcaggtgctcttccagtttatgatggtggaaggactatatatagccctattgaatttcaaaacaataagattgaattttacattagcttgccaattcctagtagtggcagcaacaagtctggagaaatagttaagttgcagaaagaaggacagcagattaagcttttccgcgttaacatcaaacttatatctaaatttgatgggaaagaactaaatagctacttgaataaagaaggagatgatggtgggagtccacttcctcaggaatatctgcatgcattagatgttgtgttgcgcgagagcccaacggagaagtgtataacggctgggagatcattttactcgagttgtatgggaggacaaaaagatattgggggtggagccgtggcgctaaggggtttctttcagagtcttagaccaacacaacaaggacttgctctcaatgttgatttctcagtgactgctttccacgagagtatcggagtgatcacctacttggaaaaacgcctggacttcctccatgacatttctcacaggaaaacaagaggcttgacgaatgaagagaaaaaagaggttgagaaagcactgaagaacatcagggtcttcgtttgccacagagagactgttcagagatatcgtatttatagcttaaccgaggaggttacagagaacctctgctttcaggatagggatggaaaaatcctaagaatagtgagctacttcaaggatcattacaactatgatatactatataggaacttgccgtgcttgcagattagcagaagtaaaccttgttatcttccaatggaactttgtatgatttgtgaaggacagaagtttcttgggaagctttcggatgatcagactgcaagaatactcaaaatgggatgtcaaagaccaagggaaagaaaggcaattatagacagagtcgtgacaggactggttggaccaacaaggtaatttctgccttcgccatgctacctcctttgttttatttttgcttacacttccattttgttagtgcctacgtattaagattgtttcattacctgacagtggcaatcatgcgagtgacttcaaactccaaatctcgaaagaaatgactcaattgtatgggagaattcttcagcctcctaagcttaaactaggtgatcgtggtcaggttagaaatcttattccttcccggcatgataggcagtggaattttctggacagccatgtcttcgaaagtactcgagttgagagatgggcactgatgagttttggtggaacctctgatcagaagtcccacgtaccaaaattcataaaccagttatgtcaaaggtgtgagcaattaggcatctttctgaacaagaatacagtacttaatcctcagtttgaacccttgcatttgctcaacaatgttaaaaacttagaaagcaaactcaacaagttacatagagcttcatttaacaatctccaacttgttatttgtgtgatggagagaaaacacaaaggatacgcggacttgaaaagaatcgctgagacaagcatcgggattgtaacacaatgctgtttgtacccaaaccttggcaaaattagctcacagtttttggcaaatttggctctcaagatcaatgccaaagtcgggggatgcacagttgcattgtacaattcattgccttctcaaataccacggctcttcaaacatgacggtccagtcatttttatgggtgcggatgtgactcatccgcaccctcttgatgattttagcccctccgtcgctgctgtagttggtagtgtaaattggccagcagccaacaagtatgtctccaggatgagatcccaaacgcataggcaggagatcattcaagatctcagcgcgatggttggggagattattgatgatttttatgaggagctgctaaaactccctgaaagaataatcttcttcagggacggagtaagtgaaacacaattcctgaaagtacttaaagaggagctccaagcaattcggctggcatgttcgagatttccaggttacaaacctcccattacttttgtggtagttcagaaaagacaccatactaggctatttccatgtgaacttgatccatcaacaactaaaaacacgctcttcaacgaaaacatcctaccaggtacagttgtagatacagtgatcactcatccaagtgaattcgacttctatctatgcagccattggggtgtaaaaggaacaagtagaccaatccattaccatgttctatgggatgaaaaccagttcacttctgatgagctacaaaaattggtatacaacctttgctacacatttgtgagatgcaccaagcctatttcactggtgccaccggtttattacgcccatttagctgcatatagaggcagactgtatcttgaacgttccgatttgtctactctaacaagaagttctaacatatctcgcgctgctccaccgaagacaactcctttacctaaactcactgagaacattaaaaggcttatgttttattgctgagtgctgaagttatggcaactgcatgcacagtcttctctatattgacagtttagcggtttgatttcattgtaaccattttagttctttctagctagtcttctatatgtgcagtttgatctcatgtacatactaatttttattaatatttgtttcttttatgatccaatattatattccttgctacatttgtttagtacattgttataaatttgttgtgttttttttcctctaacggtatattataccctctccagaccctactgttggaatactgaccgccagatttgcctaaggaacatgtatactctaaatggttctttgcatattacaacagttacgttgtgtaaacaaataaagtaatgtcacaatattttatcgcgaaaaaccccgactcataaagggaaaaaaacctacgacttacacttctgtaggatttaactatacttcattaaactccgaccttcaataaaagattacaaacttatgtaatctaaggaattataaactctaattcctagacgccaacaaccaactagatcgttgaccgttaagaattcggattacaactcttgcaatcctaagaactactctaattcctgaactccaacacaaccccccaaggtttatgttcccaagttttaagtcaccccaacttgaagaatctattcctactccagtttataattcactgaatttagaaagaaacaaaaatacaactcgataaaactcaatacaagcaaacttatctaaagaactataaaacatgaccctatgaatcagttcttcaattcttgtttccttgtgttggctgcactttgtaatcagaattcactcaaatatgaactccctctattgattgtattctgcttttaactttttgttcaagtgcgcaagttttgttggaagatccttgctctatttatatacaaagtagaccaagaatctttttcctttatgaaaggaaaccttttttacattggtttcttgtcggaaagcaactctttcaccgctttataacttctaattcacgtggttggcattttgcttatccaagttgaatcggtctaaaaaatgtatcgacacaattggttcttttcctttttctctattagtcaattatcaaaatctttttcgatctaaccaaccctacttatcactcgatatgttgttg

SEQ ID NO: 275 - DNA, 6510 bp, Solanum lycopersicum
atcatatttattgatttcacatttttttaaaagtgtacataaagtacaacgaatacatcaaaatcattgtatcttactaactccaacctcgtgatgttgggataataagaactttcaagatgtattatcgaacatattttatttaggatattagaagattatgaagtgggagaaactaatcctagaaagattattggtttggttgctattgattttgcaatccctgtttgtataacaaatatatctaaagacgataggaagttattttcgatattatataattcatttgggatgtaatctcaaagaatttaaatgaatctacttgtgaaaatgttattcatgaacttgaggttattgacgaataatatcgaatactaaaataaaatggatgtcaattatccgggtgaaagtgatacatgttcagaggtccagagcttaaaagaaattgcgaatatcatcggaaaaatcaatgttaatgatgaagttggagatgatactatatcttgggaaccaattacgcataaggaaacacttatcgcatttaaaactcttcacgttttatggtgcaattcgaaaagacaacactacagctcttggatgcaataaaaacagttagagatgagcttcaactacatttaaattttaagagaaaacagaacactataaaatcgcatttcactaaattatcttaaatatagtttgtacttttaaagaattattaatttatcatattagcaagaccatatatttatataagggtcttctgaaaatatattatcttattatcttatcaaaattgatgattttttccattgatcaaagtcggaattggaagaaaatattattttaaaaagattattaatttatcgaatattaatttacaaaagttttactataatctgattattttaaattttacgatccaaatttataatctatatatcacacgaagataaagacattaatatatatatgtatcgaaaattggttatgccgaaaaccatgtcgtttcttctgatgtctcatcttaaaattaacttgctatacttggcagtataataagtactacgtcttctagtagtgaagttcacattttttttattttgtcgccaagcaaaacggcaccggcgacggagacggcgacggtaacggtgactgatgagttaaaggagtgagattgtactgccggattgtgagaactaactagtgtatattccgtcaactaataacgccggccgaccggcgattcatttactgatctcgtacttgtagaggatgttgctaacgtcattaacttgcaacgatccaagtttccggtgttgttttgtgtgaatcatctcgttttggcttcgatcggagaagaaactgtacggatattgacattcactttaatgcatttatgttaaatatatataggtagtactcgctctgtaaatgtgttttttgaagctgaaaagcctgtaatcggaagtttttctttcgacttttttctttttgcggatattgattgattgatataagtagaaagaaggaagtcagaagctactgctttccgttttaggatttgattgaagaggagagtattgatgattagttttttttttcaatttttgaggtttaatatcagttttcataatcggaaattttcagtttcattttgaaaatcggtactaatcttcatcagatccatattttgcttgcctgtaaatgtgtttcactattagtttttctgttctctgaacctattaataggatttttttggttgaaatttctagtttctgtgctttttatcctcatttctggaccttttgattgaacttgttgagcgtagttttctccattgttgttcagcttcaaaaatagtgtatatttggtgaatcggtcaacgatttcggagagtctgagcaagatggatttgctctgctgcttgtaattgttgttgaaatttactggtttttgactttttgtagttattttctaattttttttgtaccttctacttgtatatcttgtctaaatttattggtttctgcacgtgttttctcattattggatctttttactttgaatttattactgaaatttgtttcatttgtggtacacagcttttaagcttttctggaattgctgttctgtaattgttttcaactaaggagaaggggaaaaactattggattagcgaaatgaaggaggttttggagaagtgtgtggattcacagctatggcacgcctgtgcaggaggaatggtgcaaatccctccggttaactccaaagtctactattttccacaagggcatgctgagcatactcttatgaatgtggatttctcagctctaccaagaagtcctgctctgattctatgcagagtagctgctgtgaagttcttagcggaccctgaaacagatgaggtttatgctaagattagggttgtcccagttgggaacaaggggaatgactttgatgatgatgatgacattttgggtagtaatgagtcaggaacagctgaaaaacccaattcatttgccaagacattgactcaatcagatgcaaataatggtggtggattctctgtgcctagatactgtgcagagacaatatttcctaggttggattacacggctgacccgcctgtgcagaccgtgacagccaaagatgttcatggtgaaagttggaagtttaggcacatttatagaggtactcccaggaggcatttgttaacgactggttggagtagttttgtgaatcagaagaaacttgttgctggagattccattgtgtttttgagggcagaaaatggtgaactttgtgttggaattcgtagggcgaaaagaggtggtattggtgggcctgaagccccatctggatggaactctggtgctggaaattatggtggattttctgcgtttttgagggaagagatgagcaaaaatggaaatttgacttctcctactaggagcttaaggggaaagggaagggtgaggcctgaatcagttgttgaagctgcatatcttgcttctagtgggcagccttttgaagttgtttattatccccgtgcaaacacaccagaattttgtgttagggcatcttcagtgaatgctgcaatgaggattcaatggtgctcaggaatgaggttcaaaatggcttttgaaactgaggattcttctcgaatcagttggttcatgggaactatatcctccattcaacttgctgatcccatccgctggcccaattcgccatggaggcttcttcaggtaatgcagctattttcagctttctatttggggccaaagtttgtgttgtctattaatgtgtcaattacctggccattgttctgatattctttgtatcagctctttagttgattggtgaatatcttatagcgagttaatagtcctccaatattattttgacctacattccatatttctaaggtgtagtgagatttcattgttgcattgctaaactgcatggacactgttcaactttctaagggcttttccaaggtttaaagcaagtcacagtatgtaggttgattgtttgaccatttcaatgtctgagtatgtttaggatttatgtcatgttccggttatgctcatattactcgtaaccagcccactaacaggaaaaatctgatgtttcctttttcatgattatgaagtgtagataaacacatttccttctattgcaaggtcattcgataaatagtccaccttactttttcttgtttctctataattttcaagggtttactttctttctctgtccatcattgttttcttgggaataagggttataagtttttgggatctgtccaagagatgtactcttcatcttgtgtcatattgggaacttcagaagaaatgactcggtatttcattggcaaactatggcataaaatagatgttacattttttctttcatacaactactttgatgccctcaagatataaaaatgcaatatgcagttgcggctctgctcaccttttagtctaagtttagggtggtaaaacttttctccatgttctgcaggtggcatgggatgaacctgatttattgcaaaacgtaaaacatgtcagcccatggcttgtcgaattggtctcaaatatgccagtcattcacctctcgcccttctcaccgccaagaaaaaagctgcgtctaccaccagatttctcacttgacagccagtttcagttaccatctttttcaggcaaccccctcaggtccagcagtcctttctgttgtttatctgacaacatcactgcaggcatacagggagccaggcatgctcaatttggagtacctttattggatcttcaccttagcaacaaattaccgtcaggactgttaccaccaagtttccagcgcgttgcagccaactcacaacttcctaatgtcatcaataagtgccaaaatgacagaaatgataacatctcttgtttgcttacaatgggtacttcaagtaagacattggacaaaaatgatagtgtgaatacacctcggttcttactcttcggtcagccaattctgactgagcaacaaatctctaatggatgttctgtcagtgctccacaagtagtccaaacagggaaagacttaggaaggatacaaccgatcaacgaaaaacatccttctgagcagaaaggcagcattcaagacaatctatcaagtgcaacatttttctggaatcgaggttatcatgcagctgaacttggtgtactcaatactggtcactgcaaagtattcctcgagtcagaagatgttggccgtacacttgatctgtcagttatgggatcatatgaagaactgtacaaaagacttgcaaacatgtttggacttgaaagaccagatatgctgacccgtgtgctctatcatgatgcaacaggtgctgttaaacacaccggagatgaaccattcaggtgccttgttttttccagtaccttctgcttttgattatttttccagtgaaaatggtcgtgtatacgtgcgtgtgtgaagcacacattgtttatttaaagtttaatgaacctttctctcggacttgtttaattttgcagtgactttgttaagagtgcaaaaagattgacaattctgatgaactcaagcagcaatattaaaaggtaattgtcaaccatactcttccttgatagctaagtccttaaaaccggaaagtatgataattttcaaaataaatgttccgtatttgccaccttttgatttcttttaaccttgtatatcaggaaatggttaactggtctcgcaactgctgaacgtggtctagattcatcaaaccaggcaggacctcttagcatctttgcatagcctctgtgtgtataagtacttttctcgttcttttgtttttcgtaacgactgcttcactgctagtactaaagaacactatcagtgaaaatattatgtttgtttctgtatggatattttgagttgctctttgtgttgaaaacattcaatgtgctttctttaacagtctgtggtgctgttgttggtgtttttactctgaaaggacatgaatatgtgagcctccccccccccccccccccaccacacacaaccacgatgccctatcgttgcatgctttattgttgaattgtatgatcttctcatcagataagagtcgatcctcgtgattgagtttgcttctttttcatgaatcaactacatttacattcatactatgttatattttgtgatttttatttagcaaggtgtaacttcatttaaaatgttaaatgtttcaattaggaaactaagagcaactattttttggtcatatgttttcatttatatgtgacatgtttgcatcttagtattaacattctaatatcttattgtccatagtacttggcatgtcaatatttaattctctattttaatgatcaatcacatattggaaaaatgaccaggaactatgtgtggaaataaatgaatggtctagaagcaaatagagtaaagacattcatttctcacctacttttgtctcctttaaatacttatattaacgtgaactttgttcctttttaactttttttttaatcaaaaggaacaaattaatctaacttcgaggaactatcaaaaataatttttttatttcataaaaatagacataatatttataaatatcctattttcttcaaatttcacttgtgagatttacactttatatctataaaatgtgtaactaacaaatgatggtattagtaatagatgtcctattagtacatggataagcattgattaagatgtaactatctgtaatcaaattaaataatgcataagaaataatatctaacgtaattagtttcagtattactcataaaacttaatccaatattattcttataagatctatcaaataacctcatcaactaatttaccaaacaacaaaacaacaattgaagcattgcttgccaacccaattatggttaggttttcatcaaatcaaatgtgatttctaatttagagtgagatgatgacatgaataaaaccccttttaa

SEQ ID NO: 276 - DNA, 9628 bp, Solanum lycopersicum
  modified_base (5439)..(6510): a, c, t, g, unknown or other
ttattcaatttaaataatttataattttttttaaaaaaataataattaaatcaattaatatgaaacgaagaaagtactagagttatcaatggatggttgagtagttaaaccccatcctactttgcccgtaaatagcacgacaaagcagcttccccatcaaaacaatagtatactctatccaccttttctgaaaaccaacatccaacatttattatatttatttgacaaaattataaatgtgacttttcatttacatttaatttatatttatgtcatttcatattataaaattaaattagagtcaatatcttaaaaaagtcattgaattatgagacatatattttatgtggctaagtttatatataatattatataggatgatatttatatatgttcatttatttaattttatattattttaaatgatatatatatatgtgtgttttataattaaaaatcataaataacaatttaagctaaaaaaggggacatgtttgtatattacatttttttttatccttggcaaattaagttatagttacacaagtatatttatattagatcataatttttaaaacaatataattaatatatttttgttaaaagtaaaatatatttttgttaattcagtatatttatatcttattaaggtaaataagctattttaaaaatgctttcaaatttgcctttcgcacatatgtttgtgtgccttttctcttgtcatatctggtttgatcacttggtataaaatcgaacaccatcatcacataaattagagggagttagtagtctagctaacggcaataagcagacggcgtcaatctaataacccaatgagaatacgacagcatcaaacgtctaaccgtacacgccgttaatacctcctttatgaattgtccccctggacagtgtcttaatgactggctatacccggttgaaaagacagaaacagacgggctatagcaagttacctaactagggttaaaatttaaccgcggttgaaatgattgctgcaaccgttttgacccctttggttatcgaaaggctctccctctttccctcaatgcttttgtgtccttttctttttttttgctctctttctctctcatcactcacatgaagaagctcctacttctatccattgaagatagataaatgaacacgcatatacatacagtttttagagagagaaactagagcgagaaggctctgtaacttcaattttgagtgttgattgctgtttctagggtctctttggttaccagttttgcatgcttttgagctgaggaagagtttagtgctttttttctggtgaattttggagaaggaagttttattttgtgcttgttttatgaattgattagtgtggatatgagagatctgtgttgagaattagtgtacggaaatggctgcttcggaggtgtcgattcaaggttacagcgagccgagtgatggttctaggccggtttcagagactggtaggagtagttccggtgtcggaataggtaatttgagtgatttgttttataacatggagttttccggtgagttttcttatttgtgtttgtttttgtttacaaagttgatgctgatacggcgttgtacacggagctttggcgttcatgtgccggtccacttgtgacggtaccgcgagagggtgagctggtgtactatttccctcaaggacatatcgagcaggtttgtttgtaagaacactttaatttcgttttctaccttcgttttatggaatcgcttgttcaatttcacttttaaattacactgttgaacatgcattaccgaggtactctgcttctcgttatgatgtttttagctttacagcttaaattcaatcatgatccttacctttttggggagagggggttgagtttgagaaaattaagttgtcaatcgcactgatttgcaatagagcttttatgtgatcgattgtggttgaatgataggttgaagcatcaactaatcaagtggctgaccagcagatgcctttgtataatcttccatctaagattctatgccgtgttgtgaatgtcctgttaaaggtaatggttttgttgatgctgctgtcttaatgtgtttccatttttttttagcttacagtactttttccttttatgaacattcttatctatacagttagtgcttagctggtgtttctgtgttgacttttgactgaatttgcaggctgaaccagatactgatgaggtgtatgcacaagtgactttgatgccggagccaaatgtaggtttaccattatgtttatttttaactttttcttttatttttcaatttttggttttttgatatcatgttgaataaagtagatcgagctatatatataaatcttgaatttctagttaaataaatcatctaatttcctaaatgactattgtagcaagatgagaatgcagtgaagaaggaacctatgcgccctcctccaccacgatttcatgtacactctttttgtaagactctaacagcctctgatacaagcactcacggtggattttccgtcttgagacgacatgctgatgaatgcctcccccaactggttagaagaatatttcttaatgtgttcatggattttgtattggtgacattgagtgtctaatgattattatttgcatcgttaacaggacatgtctcggcagcctcccacacaggagttggtggccaaagatttacatggaaatgagtggcgattcaggcatatattccggggtatgatacccagcagaatcttaatcaccttttgtctataaaacttaccacctccaccctgtttggccaatttatgccctttgagagcttaagcggaaggcaataaaggccaggtttccttttgaggagtgaggacgggggtggggggttgtgggtgggtgcaacatagagatgcaccatcacacagcacattcttccctattaagtgccattgttggtgtataatacctattgcattcttgtgatcacgcggccaaatgaagatcgctacaaactttatgtggctcttgtaaaaatatttagtagattatttaggattttacaataggaaaatcgtaatgaagaagagctatgcaaatttcatttgaacaatactttagtggttaaagaaattcctgtctttgtgtttcatatcataataataatttaactgaaaatatgataacatagtgtcacaactcaaaggaagaacaacatagtgtcacagctcagaagaaaaataatgttagtaatcaatattttgatttttcattttcttcttttggacgggtgctttggaggataggggagaagtctgttaacaaaattgtgtttctgtaaacacaaagttgtaagattttcaagtctcattttcttcattttcgaaattgtctttggaagtctggtaacatgctgctttatttaccatgcactgtatgcaaattattggagggttgatgtgcttttcctgccatgtaacctctggtttgtttctcacccaagcatttgaactccaggccagcctaggaggcatcttcttcagagtggttggagtgtctttgttagttcgaagaggcttgttgctggggatgcattcatatttcttaggttccattcgcgaaaccctctctgaatttatttgtgccactattagaatctgactagagaagtgttgtgctactttagaggtgagaatggggagcttcgtgttggtgttagacgtgccatgagacagcaaggaaatgctccatcatcggtgatatccagtcatagcatgcatcttggtgtacttgcaacagcttggcatgccattcaaacaaaaacgatgttcactgtgtattacaagcccaggtacctggtctgaaatgactaaataaagcaccgactaaaaggacataactagagatctttgattataagttaaatgttacatttactctttctacagaggttggaaacttagaatcagtagctcatgttgttttattgcttgttgtctatacatttggaaacattttatagtatttctccagtggttggtattaatagtgcatgttgtttcattggttgttctctatgcattatggaatcattttatttttattggttgcccactagaatactcggctgctcatatgtttgatggcctcctaatatcaataactcaacatactttaccatttattttttgatttgtatcttttttatgtccatttttttggggaaactagggtgagaaagtaggtacttgaattattgttggtgtttaacattaataaaaggattaaaccttccttactaactcactgttatgttacaggacaagccctgctgagtttatagttccatatgaccactatatggaatctgtgaagaataattactctattggaatgaggtttaagatgaggttcgaaggtgaagaagctccagagcaaaggtgggcagcagtttattctatagaaatcatctttttactgtttaaattgtgagttggcaggttgtaatcttgacctgtgtaatggacttcaaactgacagtataaaatgacaactcatttggtgactggctgttaatcatttagactgttgatttaatttttctgtagcagggtatttactattcagttctataatttaattaacttacaatgttataggtttactggaactattgttggcattgaagatgctgatccccaaaggtggcttgaatctaagtggagatgtctgaaggtagtttcgactttattttcctggtttgactgcttcttttacctcatttcacattgtaagtcattcatttctggtttcttaaggtacggtgggatgaaaattcaagcattccaaggccagaccgagtttcaccgtggaaaatagaaccagctcttagccctcctgcacttaatgtacctccagttgcaaggccaaaaaggcctagatccagtattttgcccacatctcctgattcatctgtccttactagggaaggtggatatctcatcccgatcttttccattcagtatcttgtgcacctaggggtgggcattcagtatttcggttcggttcggtttttttttcggttttttcggttttttaaaattacgtaccgaataccgaaccgaaatatttcggttcggttcggtttttgttaattcggttcggtttttattaatttggttcggttttttatttcggttcggctgctcctgctggctgctgcggctggttgctgcggctggctgctgcggctggctgctgcggctggctgctgcggctggctgctactgctgtctgctgcggctggctgctactgctgctgctggctgctgctcgacggctgctactgctgcagctggctgctgctcgacgaggacggcggctgaagagtgaagaaaagaggatgaagttgaagagagaggaagaggatgaagttgaagagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgcaccgcttataagtcttgttttcgagttaagtaattgtcatgtactttcttattttttgtttaaggttcatcaagagcgacagcagaccattcccaagccagtgggtttccgagggtcttgcaaggtcaagagttatcgacctttagaggcggttttgcagaaattaatgagacagacttgtctgagaaaccaatgatatggcaaacatcagtgaatgatgaaaagaatgatattcattctgcatcaaagagatatcttccagataaatggctacctttagggaggcctgagtcatctctcacagatttgttatcaggttttggctcctcccatgggttctgtttaccctctgcggaccaagctgcgtttggtgctagattggtgaagcaacaaacacaagatcaggaaaaggattttagcttattgggaaagccatggtctcttctgtcttccggtctctctcttaatctgatggattctggttcaaaagctcctggcatagggggtgatactccctatcaaatgcggggagatgctaggtatagtggttatggtgagttttcagtactccccggtcatagggttgcaaatcagcagggaagctggattatgcctcaaccagtgtcgccttacatgcagctctcctctcattcaagagaaatgatgcataaaccctctgtagtaaagcaacccgaggctgtgaaacccaaagagggtaactacaaactatttggcattcctcttacaagtaatgtttgcacagatgctgttatgatgcggaaaagttcattgattgatccagcaagtgacatgaatattggtatacaccctcatcaatcccttgccactgattctgatcaaaggtctgagcaatcaaagggatcaaaggtggatgatggagttgcagctaatgatcatgacaaacaatttcatacctttcatcttgctgctagagataaggatggcaaagggcatagtagttctacaaggagctgcacaaaggtttaaatctgatttgtcacaactttagctattggctttaatgaaatttctaatgatttatttttgcctacaggttcataaacagggtacagcactcggaaggtccgtagatcttgcaaagttcaacaattatgacgaattgattgctgaactggatcaactttttgattttaatggtgaactcaaggctcggagtaagagttggctggttgtatacactgatgatgagggtgacatgatgcttgttggagatgatccatggcagtgagtacttaatatcattccttttatatatcaaagtgattattttctttcctcctgcgctgcttacttaatattggcttgcactggtttgaaacagggaattttgtggtatggttcgcaagattttcatctatacaaaagaggaggtgcagcgtatgaatccagggacccttaattcaaaaggtgaggacacttcttctgttgctgagggctcagacgctaaagaagtgaagaatctgcaacttccttctgaatctggtcaagcagaatcttaggttttcctccaaaattgaggtacttggaaaagatttacttgaagagagcaatctttttgcttcagttttttaaaaccattttccctgtaaatgcctccaggtgtttttctgagttacttaattactgttgttttgtatttgacaggtttataagatagcgaggagatggcttttatccacctaggtgttacttttttggggatttttgaatataacctacaatatcaactccctttgacgtgtggatggggatggtctcttcatataaatgcagcttcagtatttgcagttttgagcctttatttggagccaatatctggccccttatctatctatatacatagtatatgtaaattatcagcgttggtcattaacgttgcttctgccaatctcacttttgtacataccaatttctctagctgtagctgtaattaagatttcgattctactatgtatgtacctgccttactgttgatttttgtggaagtggtatccaactactttgggcagataacatattttgtatcagcaattatggtaatgtgatagaaaagaaggtttttctgagtgaagagctttttctgtcgtgcaattttggtcattggcctatctatttattcttgttgcccaatatccttatccattgtcttctacacaaccatattgctgcttgcgtttggaaagttgggcaaatcatgtagttgtattaatgtttgatatttgaattataggatagagaggagcaagacattgtaaattcttcttcacgcatgctttatgcagcaagccaaggtttttttttcgtcttagatgaatagttttgtctaaagacaggtcttttttttcgttttagatgaatagttaactcattcaagttctaacctatcttaagagaatcgacagttgaacacaatttaatccgttttaagactctctttacgttgatgtaatgtatattgatatgaattattatctatttttattatatcttgtaggatttttcaccccaaaaaattgcaaaattggacgtgttttcatgccccaaaaaaagggatttttgtgcctaggattgtcatttttctttccttattcttattagatagttttttggcaagaattttggtagtatttttacattctttttagttagattttagtatttaataattgccataaaagtagattgattttcatgttatttggtatagatttcccacagatatagcggtgaatttgatttttttttttacaagaacaatattattataaatttaataggttgtcttctttacgccacttttgaggggtgagattatttcctaacatcaaaatttttaattaaaaaggtaatgaagtactaattattgactatttttaaaaaaataacagggtccagattaccttttaatctaagttcaggaattgattttatggaaaatggtcatatggtagagggacaaatatgacattttccgttgattttattagtatcatgattaattttaaaatactaaatgcttaattttgaactttgagaattttactatcttttatctttgtattttcatttcc

SEQ ID NO: 277 - DNA, 8680 bp, Solanum lycopersicum
taaatgaaattaatgaactaaaaatatcaattaatcctttcgccaaaaattcgacaaggacaaattgacatctgattaatggttctcctaatctgcaattttataccacataaatgtaatacaagtattttattttctctatataaagtggtgtaccaaagataattttgtttttcaatatttttatttcgattttaaacgtagttttatatttatatcttgtagttatttttgatgaaacgatatgagataaggtatccgacaatatattatttatctctctttttttttctacttagccaagccaacattgttataatgctacaaaaaattggaatgattgatgtttacacacaactttatacattcaattaatgatatatagacaagagacaatgttaattagtagtaggtaaactaataatttacatgaatttatttaaaatgtcaaatctgcttatataaccaacatatatatttttaataagttaacttgtttaataggaaatggacatcgaaaaatgtatattctgcatgggaatttgctaattgttgaggaaatagtcattctatttgtctcaatgaataacttaataataaagtaccttaaaatcaacaaaacaaaaaaaaagccccaattatttttgcttgatttggttaaaaccaaaaaagaaatgaataaaatattattgtgtctggaaatatagagtcaaatttgaaaccaaaaaaaaattaaataatgttaaactggacatggtagagatttgttgattaacaaggggacacattagacatcccccgaaaatacagggagtcttttatacattcccctttacccccaccccctcagaatgagcagtcattatctgtatgattattatacatacatacagtatcttatatgtatagatacaaaatcatactgtatctataggctatacatacatctaattatagacagtcatactattcgtcagtttccccccaccctagacccagcagttgcagcgctgctttagcagctgctgcaatttgcaggttcatctatacgtacaacttttttctgtatgtttatttgtatctatatatatatatatatatatatgtatatgttgtgagatgtgaaggacactcacataaagtgtgatttgatatgtagagaaaaagcatttcactttttagagagagaaagaagagagagaaagagaggtcatcttctttatgcaatgcggtgagtgcgcagttgaactagcaaaaggtactatctgtgttaattactcactttattattatgtctatgtatttatagtttatacatacatattttttttttgttgtatatatatatatgtttaggagttctgagaatttctctctgtttaatcttagggtttaaagatgatgtgtggacttattgatctgaatactgtggataacgatgatgccggagaagaaacgacggcgccggtgtcattggattcaccggcgtcgtcgtcggcggcatcaggaagttcggatttaacgtcgtcaactacgccagcggtggcatcggtgtgtatggagctttggcatgcgtgtgctggaccgttgatttcgctgccgaagaaaggaagtgcggttgtgtacctgcctcaaggtcacttggaacatttatctgagtacccgtccatagcctgtaatctccctcctcatgtgttttgtcgcgttgtagatgtgaagctacaagtgagtgtacttctcatctgtttactgtaaattttgttgaaaatttgggatcaattggttgaactgtttgcctgtgtagcttcctcttgttagtgttattccagagaattgtgaatatttgtttagttacctggcgtttggttgccgtatgtgttcaatttcaggcagatgcggctactgatgaggtctatgcacaagtctcactagttcctgacaatcaggtattatgtgcttccattgttttctgattttgatgtgcttttctagctgcttaaattttgtccctttaggtataatttggcaatagaagcattgtcatttgattttagtctgttttaaccattgctacttgaagccaaagttcaagcattattcaagctggaaataaagagaagagaatgaggcaaatatgaattatgtggttgtataggaaggtggtattgtcattaactttgatatgtcactcttattaaagtttaggcggatgcaagttcttgttgataaagtaatgacttattgaaatgtttgtgtattataattttatttatgaacaaaatgttccgaaactgttgttttgttgatttcttttcattgagttcattgtagtattttaaattccttagcagattgagcagaaatggaaggatggagacattgatgctgatattgaagaagaggaaatagaaggtgctggaaaatcaataacaccacacatgttctgcaaaactcttactgcatcggataccagcactcatggtggtttctctgtccctcggcgggcagcagaagattgttttgctcccttggtaacactttcttgaagctaacttcaattgtaaatagtagatgagagtgcttagatatcgttgtatgggtttataccattttaatatccgacttacaggagcacattgttattactgcaggattacagacaacagaggccctcgcaggagctggtagccaaagatctacatggtatagagtggaaatttcggcatatctatcggggtatggaaaaatgctacggtttgatacatgtgattgagaaaatgctttgtctcggtagatgatgaatgaactttttctcactgcaggtcagccacggcggcatctgctcactacaggatggagtgcatttgtaaacaagaagaagcttgtttctggtgacgctgttcttttcttgaggtgtgaaaagctacatctgggaagaagttagcattttgttattttatttctcatgttcccattatttctgtaggactggtgatggagagcttaggttaggagtgagacgagctgcccaagcaaaaacatgttctagttatctggctccttgtagcaaaccgttgaatgttagtggcattgtagatgctgttaacgttatatctagcagaaatgctttcaacatttgttacaacccaaggtattcaatctctgaaaaagatcttagcttatgctattccaatgctagtttattcagatgttctattaatttctttatgcatgtgatggtgtccttttcttatactttcacccgcttgtatatttactgcaattcaaagcttgattttcaaatgttgttcgactgtctggatgtgagttgaagtgctacatgtggattgcaatgagggaaaactatttcttctttgaggttttaatcattatcttacctcttactctaagctagagtgcagtctaaaaacaattgattttagggggaacagtagagttttccataaatagacatgatactgttatatgatgaaagtggaggatgctgtcacttagatatgggagtttgggtacccctctactgcatttgaatgcgctgggttctgctcgcttacaacttccatatgatgaatgtttctctacaatttaaatcagtgactttttcggacaatgtacaaaggattaccatcaacacaatatttgaaatggagttctttatacttttctatgagattgagctatttattggcttagtttgaggtcctatgaagtctctgtagcaccagtataataagtagtttgttttgatttctgaactaagtatgtttactctggtctattttgtaagccattgctttctatcctagaatctacttgtccatcacagtccattttctcttagtcctttgtatctttttgtttcagggatagctcatcggatttcattgtaccttaccacaaattctctaagactcttgcacatcccttttcagctggaatgaggtttaaaatgcgtgtcgaaacagaagatgcagctgagcaaaggttagactatacttttttttttgtgcgcttaggcttggttcaagaagtggtcgtttacacttctagtgattcaaaacactgtacatcaatatctgacgggtatgtatcaggttcactggactagttgtgggagtcagcaatgtagatccagttcgatggccaggttctaaatggaggtgcctattggtatgcttcctgtcctgcactccttgtattctgatggcataaagcttaacctaaatacaccacttaagtcttaacatctggttaagtaattgtagatagaggacaagttcttttctcacataggttaaatggttgttaggtatgggggctgatattctatttggttgagataaataggaccttgctcatgttacctagtttctgctgtttcatatattgataaaatggaagcaagaatagtctgcatatgtagatttatttttctaggtaaggggtgtttgcagttcgattagtaagtttgttttttgatgtttaagtcgtttttccgttgctttggttaccgttggatttttccacttcttaaattattttttgttagtcttttactttaattctgaaatactccctccgttacttttactcaccacttattcttaaaatagatttgcatttttactcgtcacttttgacatgtcaagaagaaacaatagttttttttccatgttttaccctcaatattaaatacttattttccaaatcatgttctaaggcatcatttaataagaaatagtttgggtaaaatatttatattccaagtctaactgtgacaagtaaaagtgaacgaaggatgtataagataatatacatctaaagacgttaggttgaccatattccaacataatgcaaccaaattcattttatgattgatgaatactttcatttatcaaaagaagtagttataaaaaatgaagaaaagatctttctataactgtagtatttgttatcacttgtgaaaatctggagactaggtctggatatgctcacatagctgcaaaatgtgataatgttctcacaagtgttttgcaacttttttcaacttatgaatttcctttatgaagtgtctggtggaatgatttcacgaataaatgtgaaacctttttttaaaactgccaagtttattttatacttgcaaacagtacagcacatgatttgttgtttcagagtttttgtattcatttgtcaatataattacaactacggaaaattcatgcagaagtatctcaacattgaaattactactgatactttttaggactatgtttttgatcacttctaggtaagttcactttaatttattgaggtgacttacatgtgtataattctccccttggaatgtaatgtaacagtcagttctgctttcttcatcctttattagttggctaatgcaacccccctccgttttttgaccaaacaaagtgttgatttagttaggcatctttaatagtggttctaatctgaacagttgtttttctgatgtctctagaaacttatttttgctctattaatgtgttactgaatggataattcaggtcagatgggatgatcttgatgtttctagacataatagggtttcaccatgggagattgagccatctggttcagctcctgtgcccagcagcttggtgatgccttctgctaagaggaccagggttggcttccctatttcaaaggcagattttccaattcctagaggtttccctgcattccctctctctctcttgagggcacacacaacacaacacatgcatatagagacgcactcacacatctcatttctgcttgaattctgtagtagtatgatgcttctgcaatgttaataactagtctgtgccttcatttctgacagaaggaattgcagtatcagactttggggaaccttctaggttccagaaggtcttgcaaggtcaagaaattttgaggatgcatgctccttatggcggacttgatgctcggagtcctcgtccagcaggcacaagatgctttcctggttttcctagttctgggatatctagaatgggaaacagcatcagacccctgtttggtgacactgacaagtcccatgaaagcattggctttagtgaatctcttcgattcaataaggtcttgcaaggtcaagaaatttttacaagccctccttatgggagagctcaagctggtatccaaatgcaggagaaaagtaggaccggtatttttgtcggtattcaggttccaaaccatggaaacaggtggcctgctccaaatcaggataataacactccttgcaagccaattaatcctgtctcagcatcatcaccgccttctgcactcaattttcagcatccgagccctccagcatcaaagttccaggctatgttcaatcataaacatgatcttgttaaccaggcttcgttagatctgtctgagaactgttgtaggtatccgtatctctcatctggttcacataccgaggacatcagtcagaaggaaggtactcaaggaatcagctcgtttggtttcttaaaggagcaaaagcaaacaggactttcatatctttctcttgggacacagtcgtcattcaaaggcaatcaaaacttagtttccacttgtaaaactggttgcaggatctttgggttccccttgaccgagagtaaaataagtgcaactagagcggatactccctctgaagctgtatactcacatggtctagaaactacatttctcccttccagtgatggaaagttgcagccggggccaccattgatgactaacgttgtggggacaaattttaccaaagtaaatgacctctatgcagcaagagatgtgcttcttgatattgctctgtagcaggtgtttgttgtgaggttgtgctagaatatgtagactgaaggatgtgtgtgcagcattattgattattagcttttagttggcgttgtaatcttctggctgttgagtgcgcaagcatttggttgccagtagaatgcttatccagagatgagaattgagagttattaatgaagattgataccgttgaggaacgtatgttcttgtaagtacctgcactacaaatttcactgatctactttcatatattttcaatgcataatttcatgaaagtttcaataaataattactttttgtttatcgggggagcacagctgtagattacctgaagtttaacttttgattgaatactaaagattcactctatgagaagaaatttaactctgttttcaatgagattctgtttgaatactctctgacccagtttggttttccagcactctttagcagttgcttggtttcagttccttaatttttcttttgataacatgggttcagagcatgactttatggttgtttcacattgcaggaaaatttggtgtatatgttcctgtgacgctgatgtactatgtaacaattggaagctgtgtttgctgcatcaaagatgtctgtatgatagttgtactctacttgagatgacttctgtatttgtatatttacctagtctagatttgctgtgaactaactcgagctcctataaatcggtaagtttgttgtaggagctctcgtctcaggaacacaatactgtactgaattttgtaaggaattgtcatgtatattcctgcaattaaacaagcttaacatagtttcctgtttgttatttgataatcctgcatcccttgattttctctactgtatttattatacgttgcatttgaggtttgttacgtaaaattcgtgtggcaccaaaagattgacctcagaaaaataatataataggcttgaaaaagtcgaggagttggtgtctgatactcttttaatattctttactgcgcttgctaccgttggtctttgcaaatgttcatttgcatgtcacagaaaacgagaccgagaatattgtacaacttctcaacaacgtcatggccttcgtatattatttggttttgaccaaaacctaaccattttttcaactcaattgccataatactgacattttctctctttcattaaattcctaaataaagagagatctttacccctgagaaaatcagacacatcatatattatatggcaggttcaaacaacagtagagtcataactcttgtgacaacaccaacatgggctattgctgttgtgtgtttcattttaattactatttccattcttatagaacatgtccttcatctcttagctaaggtatgtttgtatttttgcatgagactgttttcggatttataacccgacaacaacacttactattcctgacaaacttcaaattttgattgttaaccttgtactacttcaacaagaagaggaggaagtctttgattcaagcactaaacaatatcaaatcaggtactactaattgaatatataattggttttagctagctagctggttgcttgacttttgtatatataaaatttttgtttcaagagttgatgcttttgggatttatctctttattgctgaatgttctccaaaagcctattgccaaaatttgtattccaaagggtgctgctcagacttttcttccttgccaaagcttcacaactgatgatgttgaggaggagtcaaactgtgaacaacaggtctttttttttattaattagctgcttttctcatcgcgaatcaacaggaaatttttgttgtgaaacatgattttcc

SEQ ID NO: 278 - DNA, 10428 bp, Solanum lycopersicum
acatatatacatagctactaaaatgagtagacgtccaaatttatctcaaaagtaaaagactagtcaaagctaaacagaaagagaaagattgattcaggatgccataagctcatcctcaccatcgaatatttcaacaacagggtcaatatcaacactgacgactggtgtttgaacggttaacatgaaccctactcattcataatcaatcaaacttaaacaaaaaataaaaattaagtagaaagaaaaaaaaaaaggagaagaagagaatcaatactatgattatgctccacatatatttttaaaaaggaaaaaaacaaagagaaaaaggcaatacaaagcaaagcaaaaaagaaaaaaaagagaaaaaagagagagagagagagatggttgatgaagatgtgtgggttctgtactgtctttaacctgtcccctccactcaacacagtgttgggtctatctttcaaaacaaattaaagaaaaaaaacagtttttgagtccaaaagggcactaaccacattggctttttccaacttttgcttctgtgttaccttaagcaattgtctatgtcttctgcttcttctgttccctcttctttcaactccaaaatgggagtggaaatggaatcatactttgaatttcttgttattatttgatacccctttaaccccttttctttctttttatcttatttccttccaaaaacatgactttcttgttcttttctgttgagtttcttttcctgttcttgctttaaagacaacccctttttctaaatattagcatttcttgagtatgattttgacttaatttttttcctaattttctattcagctttgtggcaaacacttgattaccctcttactcaacttttcttgaatttgcttttttgtgtcctgttgttgtggtctgtgtaatgctaaactgagaaaacaagaaaaacccaaaacaaaaaacatacaaaaagaaccaattttttttgtttgggggtgtttttttttcatatggaaattgatctgaatcatgcattagtgagtgaagtggagaagaatgtatgttgtaatgaagaatgtgataaagggggtggtgggggttgtgttaattgctctttgtacacttccactacttcttcttgttcttcaaatgtatcttcatcttcttcacttgctcttacctcaatttataaagagctttggcatgcttgtgctggtcctcttactagtttacccaagaaaggaaatgtagtggtttatttccctcaaggtcatatggaagaagctgtttctgcttttccattttcacctgtcaagattgatttaccaacttttggtcttcagcctcagatcttctgtagagtggaagatgtccaattgcttgtaagggacttaattttttgcccctttttggtttaaaggttttagctttgcttctctttttgtaatattttctgcccttgatttttatatgatgtcaaataacaggcaaataaggaaaatgatgaggtgtatacacagctcactcttcttcctcttccagaggtaagaccagttattgcttacatgttcaatcttgattttttaaattttcttgactaattacatgtatacctgtcacctcccacaacagctacatggacctagtaactctatccacctagtcttggacaaaatagaaaaaattacctagtgttgttgtctctgctgtgtcatgttcaattttgatcttttgatgttttatgttcaaattctgagtaaaggtgttaactttaatgtgttaagctgctgtttttgttcatttatttacatggtttcactgtaaagggatcttttcagtttttctacttgaattggtcttttgttttttagtgtaatatcttacattgagcttagactgagttttccctgctttcatggtgttttccagtcaatggctataagcttagaggggaaagaacatgaagattcggggacggatgaggaagggaatggagtcaatccagggaaatcagcttctcacatgttctgtaaaacgctgactgcttcggataccaccacccatggtggcttttcagttccccgtcgagcagctgaagactgcttcccccctctggtgtgacctccattccaggcttttgctaaagagatctttagttgatttcttgtaattgtctggttaatttacttctatcttggtgctacattattaaatgtaggattacaaagagcaaagaccctcacaggagctaattgctaaggatctgcacggagtagagtggaaatttcgtcacatttatagaggtattgagttaaatagttagatacttgtttggtccgaaatattaatgtttgatgcttttctttcaggccagccaaggcgacatttgctcactactggatggagtatctttgtcagccaaaagaatcttgtctcaggggatgcagttctcttcttgaggtatacatacctgttaactttgctgtatttgaaaataaaattttgtataactttaaatgaagtagaaccataaatggagatgaaacaaaattatattcgagtccgctgaatccacaacgtgtgtttaagaaacttaaatccaatttagtacccgaggaataagattattttctcccatgataaaatggataaaccacactggtgtagtggtacttcgaaccctagggtacttcgaaccctaagagtagccagatcacacttacaacttactttgcaagtgcatgaaatattgcagaaagaagtagagtaattcatatttttggtaagtaaaaatcctaggaagcgcacatgaattatagtcaacaaagggtagtttgaacaagtgttattgtgccgtacggaaaagttacaacctatccaatgtaaaggtgctattcaaatcacatcatttcccctggtgtctttttttaggaaatcacctattcattttctcattcacacctcttaacaaaccccacaatatcagctcaatggtatactccaaatggttcatctttttaggtactaaagcagctttgacggtgagctgggaaagggaatgagggtggaaagtgaccgatatgaaaatatcaagtcattgtacttggaagctggaaaatcattaggtctaatatctaggttttcaatatgtcatggtgactcgttaggatgccaatgccaagatcttaatgatcctctgttcaacttttgaagcttgtttagtcacaataggtatttaaattttattcaagcagtcagatgatccttgcaggggagaaggtggaaatctcagactgggaataagaagagctgcaagacctagaaatgggcttcctgaatcgataatcaaaagtcaatattctggaccggatgttctttcgtcagttgctacagccctatcagcaaagagcactttccatgttttctatagcccaaggtatctcactatatctctgtgtatagttctctatttagttgttggcctatttatatggtaaaatccgtggcaatatccctcatccatacatcttttactattttaggctgtgcgacgttaatgagatttgatattcacatagcttatattttaattgcatttaagtcatgaaggcataataaccaaatacatataaacaaagattgcttatttccatccaaccagtcatttgcagagattgaaatgaattgtctttgttttggataccaccgttttagtgtccaattaatatcttaacaaatacaaatggtgtaggtgtgtaggccttcttcgtgcagatcagttgtattagaagatttgctttgctttaaggaaacagttctggaggagtaaagttgtactgtttactgtcaaacttgggaactaagctagtattgatggtgtgaagtttgatatccagtgataatattatactcacttatttgacataaatatgcttttgaaaaatccaaactaagttgattatgggtggtactacttgtaatcatgttgcagtttaaatgtttgtaattacttgaaaggtcgtagatagaatgattgtattggtttagtgagatagcactgaaacatcactgattgccatcattgctaacaaatattgtgttgttatagtaatgatgcactgaattatgaagtaagatttggaagattacaattggggagctccaaaatgaactgatatggtttcatagcagtgtggcaatatatttggctttattgcgatccatctttattatatttgttagtttgttcctagattgaggcacaactagtggctttctgtttatttatgtggcatcagctgcagaacaaaacataattgagggtagtaactcgttgagctccccacattggtcatttagggatgagaagatctgtttatattgtcttggacaatcctcacctcatgagctagcttttggagttatgttagacccaaaatccatttttttcggcatgccaggggtgttgactgttgagttcccacatcagtcatttagggttgaaaaacctcttttcctttttataataggtatggagtctagatgttcaaagaaaaagaggtatggagtctcttaatatggtcttggagaattctcaccttatgagctagtttttggggttgaattagacctaaggtctatttttgtatcataacttatactagtacccaggtatttgatccattctataggcagtgatctttctgtttgccaaaccatcaattatcttccaactaatagtcctctgattctgaacttcaggtatctcatgaaaatttttcagttgagagacaacttagactcattcgtttagactgagtggttcagatgcatgtctttttatgcaaatgtagtgcaatgcatgctgtagtggctcatatcaagtagatttcctagtaggtcaatgctaggaaagcaacttgtctactggtaatctctacttcggctagttcatatttcattgtcagcatctaaaacatcaaaaggatgattttgaggttgacccaaatctttcactctgtgctatcatatatataactgcacttacctggaaaggggaagtactttgccttttcatatttatgaaatgaagcagctgtctctttttagtgatgttcatattcgatgcaatgttgttcattcagattttcttcatgtttgagttgaataagaaaatgttaacagttaaatatatcatcgaagtgaattatttcaatgttatgaaaccagttttacatcccagaagctaaatttcttttggaagaacccatggtgtataaagttggcgaggaagtttgcatctctgttagatatgtaagaaatttgattcactggtataaagatattaatgctcctgattcaacgtgtgaaaattcagacttaaaaaaatattacctattggtaaaaccattgacaatatggaagggttgattcagtcgagaggatgagaaaaattattatttctgctgcttctttcaattcatgtgtttcaagcagaagtcttgtcctgattatgaaaccgtttatttcccaaggaataaggaataacaaagaactatgattttcgtaaaatattctggtggacgaaaaagtctcatattatgtgcaatcttgtagactgtagtcaagtccgaatcttaaaacatgtgaagtttattctttagtcactgctgcagctttcagaagtttgtgtcacgaattgtcaagatattattgttgttcttttattgctacgtagatcattttgagttaaaagttttttcttataatgtagggcaagtcatgctgatttcgttgtaccttaccaaaagtacgtgaaagccatcaactctcggattcctgttgggacaagatttaaaatgaaatttgatttggatgattcacctgaaagaaggtaattgtatccttactaaataccattatatgctcttcttcctttcattggtttctgttgtaataaaaacattccatcactgcatgcaggtacagcggtgtagtgactgggataagcgatatggatccctttagatggcccaactctaaatggagatgcttgatggtatgcctgacatatagttatcattttgttgttttttaagtactccttccgtttcaatttgtgtctggttttgacttggtacgaagtttaaaagaatacagtagacttttgaatcttgaggtcttaaactaaagatatgtagaatgtatcaaaatgccttttagtcttgtggtcataaacatatcatgtggagagttgtaactgaagagttcccataaaaggaaagaggcattctttttttaaacaaactaaataggaaagtaagacaagcaaattaaaacgacgggagtagttggtattgctccacctatcacttcatgtttttttgaataggttggaacttgttcttctatttatctcagggcgatttttttgctcccttgttattcacagaggcatatatgttcttgaattttctgccggtgttaccttgtgagttagatcagctctacttagagatcttgtaacatgtaaatctgcttgttgaatacctctaggaacactggaaggaccgtatattttttggtttgtttgatcaggtcataaaaattggtcatgccatgaattatcaaactattctcactgaaatatgatgagaaattgttaaatggtctggtgttgtaagatgctttattgatttctttttcatgtcaagactgataaagtttgctagttataagttgcttgcttgattttttcgtgtcaaggctaatagagtttgctatcggcaatacaattaaatacattcacctattgtatattttgagttatcttcccaaacaaaactgttacaataagtataaggcctattaagcaacttataaactttttgatatatgtgcctatgtcatcaactttaataggtcagatgggatgaagatataatgagtaatcatcaggaacgggtttctccttgggaaattgattcttcagtttccttaccaccactgagcattcagtcctcaccaagactgaagaaactgcggactagtcagcaggcaccatcagtactggacagccattttgctggtactgatctaacttttctaaatccttttgtattatgttgtcattatgtcgtatgggtactgcgtttggactttttttatccttgaatcgacggtctgttggagacaggcctctctacgaaggtctgcgtacacgtatacactaccctcccagatcccactgtgtgggattacactgagtatgttgttgctggtgttttcattaagttgtgattccactgaagttcatttttattccgattttgttattttatcaggagggagtgctcttttagactttgaggagtcaataagatcctccaaggtcttgcaaggtcaagaaaatttaggtctgatatcacctccctatggttgtgataaaccagtccgcccactggatttcgagctgcaaagagtagctcgtcacaatctcatgccaaatggtgtagagaacattattgttggtgactttgtgaaaactcagcctccaacaacctacacaggctttctggaatccaataggtttccaaaggtcttgcaaggtcaagaaatttgctcgttgagatcccttactggaaaaggtgatgttaattttggtgcttggggaaaacctgaatttggttgcaatgttttcggcacatatcagaggccgagagccaatttctatcctctcgcttctgaaggggcgaggaatgtgtttttaccttacaatgcgatgtatagagctggacaagatcccgtggttccctcctacagtactaatttccaaagagaaaatcctaccttgaaccagaattcaatccaaaatgtggttaggagggaagaagttggaatgccaaagtttgtaaatgagcagaggccaccggagatgtctaaagtgtccattccagagaaccatttcaagaatgaaaatgacgactccttcaatgcacaggctccatgtaaactgtttggcttttccttgacgaaagaaccatctactcctagctcgcagagttctggtaagaggagctgtactaaggtaagtttccataagttgcacatagcgaattggaactgttttttctttggactctattgctaatattgaataaatggcgtgaaggttcacaaacaaggcagcttggttggacgagccattgatctctcgagattgaatggctatgacgacttgctggttgagttggagaggcttttcaacatggaagacctcttaagagatcccaacaaggggtggcgaatcttgtacactgacagtgagaatgacatgatggttgtcggagatgatccatggcagtaagtctctttctcatgcatctccgtttctcatcactgtctcaattgtttgatactacattcaaaaaatattacttcttggtttattaatgcatatgaatcactagaaccacacaaatttctcttccaattagctgacttccactagaaatcggagttttggatattagctaacctccacttgaaatctaagtattcttttacttttcttctcccaggttaagataaatttctttccttgagctgagggtcaatcggaaacagcctctctacctccaaggtaggggtaaggtccgcatacactttaccctccaatgtgtgtttattatggaggaaaaatgcttctgagaaaatgttcttcaattttcccgtctttgattgatcaaaaaatttggagaacattttcttcaagtaaataagtcctttaaatatgaggaaaatgacttccttagtcgaagtagggaaaacaagttcctaaaatagcataccatactgattttctccattccaccctcccaacacacccacaccccattctcgccattctcgccactcccaccacacataatgtttcccttgaatttatacacaaagctacttatcacacacaagaaaataaataataaacactttttttcaagaaagcattttctggaaaaaacattttccttcataccacacaccttaaattagaacttgttattttgcaacttctgccgagcagcaaaatcttggttcagggaaaaagtaagggtctgtacacactgtcctccccagacctcacttgtgggattacacttgttggatatgttgttcgaaaaagtataatttcccttaatagattgatttgcttatcagtaacttgtgtaccttctaaatgacttttcgcagtgagttctgtgaggtagtatccaagatccatatatacactcaagaagaagtggagaaaatgactattgaggggatcagcgatgacactcaaagttgtttggaggaggcaccagcaatcatggatgtctcaaagtcttcttcagttggccagcctgattcatctccaactgtaatcaggatttgaataaagtttgaatggagtacctatgaatgttcatgctttttttatgctatgttaagtgatatatgtgatgataatagtactctacctactacatgttcttgttatgtttaataaattattgtcacttaacatgttatgttaaatgttggaagtctgtaatcaactacaatgggagcttgtatgatgaaaactatgtggtgactcatatgtcattataactctgaattctaattatgtttcactatgtataatattgaacattgtatgaatacccctttctttctaacccccaccccaaagtggtatgcagttgcttgaacctagcgcgcacgaggtggtgcttgaccaaaaggttgagggcaagaatacttggtgatgatagtttaagatcaatgtaatattgagacaactaagtacatgatagaaagatgttgagctcgacttagagggcaagtccaagaatacttgggtggatataattgaagatcgatgtaattaagacaactatgtaacggattggacacaaacgcaccaaaaaagaaaaagtggagcccacctaccaaaaccaagttgtgtacttgtgtttggtaaataaaaatattacctacttaatcttagaaggttatattattccattttgtcaaatattttatttagtaggagtattatggattgaaaatctgggctagacaacactactttgtgaaaagagtgtttttctaattacaaatttgtggggaaggggagttggtttttagtgacttagtgccatctaaggtctactacctagattgcattggtagtggcaataggtcacaagtactataatactatcctatgtctatgtgggcttactatttcaatattttaatgaagtggatgtggatcaccaaaatgatataaaagcactaaaaccaattttcataggctatatataaatctcatttaaaaaagaaaaaaggaaaacaaaattctttattgtccccccaaaagtgtttttc

SEQ ID NO: 279 - DNA, 7261 bp, Solanum lycopersicum
ttattttagtcgattaattaattcttgtatagtattgtgtgaaagcttagcaaacaaagtacgttttgtcatttctttattagttataatcaatcaagattcctaaatttcttcatacaaagtgttattagtacgatttcgtgttaacttagttttccccccttctttagctgcaagagtctctctctaaagctgcaaaagaatcaacctaaaagtattattatacagagagaaaagaaaagagtgtgtacagggtaagagcatgcaacactcttttctactttcaagaaaacagtgtagtagtatgtgcagagttaataaaaattgaatcttttttcatttttatcataaaggggttttggggttttcatttctaaagcttagaaagagaggaatcagaatgatgaccactttcatcgaaaggtcggtttcttttgatgataaagaaagttttttttttttttttttgatttttaacaaaggtaattgatagctaaagacccctcatgctttggtccgcgtgctttgatggaaaaaataaactgaccccttttggatttatctttatattcttccttataatttgcaaaaattgaaaaaaaaagaaaaggagaaaggattttgctttgatggggtgttgatggagagtaaggcccacttagattgcagagagaaagactctttttgcagggtgggtgtttgttctttggttttggattatttgggcatgctctctgtgtccaattagattgttttcttgtataataacttagattctctctttgctcttttattctccaagaagatgttgtcatgttctgtagtatgttttcattcctcttaagaatcattcccttgacttgaaatgtgggttggcagttatgttagtttgaactaagaaagatgtcatcttgttgacttgctgattggtggttagagggagttctttttttttttttttggaaagatggggtctttggttttggttttggggttgatgtaaagggaatcacagaggtttttatgggttctgttgaagagaagaacaagccagggagtttggttagtggagcacatactctacttgaggaaatgaaattgttgaaggaaatgcaggatcatactggttagtttccttgtgaattcttgtttttggtgtttggagttgtgtatgaacttagctcagactaggcagaatataaaaattgaaacttgaaattgattatctagttttaatagttgtaaaaattgaatctttacgtggattttgttgaatcttgatgcaatatagggggaggaagaaagctaattagttctgagttgtggcatgcttgtgctggcccacttgtaactttgcctcaggttggaagccttgtgtattacttcccacaggggcacagtgaacaggtttgatcttttttactgttattgttgtttggtacaactactttttatcagcatttctttacaaaattgtgcaaaattgtctgaatttgaatctgttagcatcgacttaagaccggattgttcaatcgtagtccttcaaaccatttatctgaagaaaatactctcttatcctgcttgttcaaacaaatgttccaggagagctgttttgttctgaattttcttttcttttgtactattagaatgttgaagggaatcatgaaaacaagttgtaaatttgtatttgtagaattcaaacttgaatcaagttgtagttatggctaagaataatttatgttcatttcttagtaaagcctttccctttcttttctttaaatattgaagacttctttttatacaagcaaatatggatatcctggtaaatgtattccagtagttttgttagtgtagttaggaaaaccaaaaagcctaagatctcctatggataacagagtcctttggtcatttgttctgtccattcacagcttgtgctttgttggttgttgaaagaagactatttccaagagaagctgataaaaaactaacttgttgcaacaggtggcggtttccacgaatagaacagcaacttcacagatacctaattatccaaatcttgcttctcagttgttgtgccaagttcacaatgttaccctgcatgtatgtgcttttaagatgatgcttttactccatataataacttttattattatattggagtactatatggagttattgtgatatcatacgttgtttgttttgtcgtgtcatttacaggcagataaggagacagatgagatctatgcgcaaatgagcctccaacctgtgaattctgtaagttttctaatctactatttgtactaatttttatacagatgcaaaagtaataatggtatgcatgctgaaattcttttctcgtatgcgttcttggttaggagaaagatgtcttccccattccagattttgggctgaagcctaataagcatccaactgagttcttttgcaaaacgttgactgccagtgatacaagcacacatggaggattctctgttcctagaagagcagcagaaaagctgttcccgcccttggtgagagttatgttttgttgaatgagttacatttgccagatggaagtaaaataagacttaagagttttcctgatgtcttgtgttgtatttacttgctcttttaggattattcaatgcaacctccaacgcaagagcttgttgtacgagacttgcatgataatacttggacattccgtcacatataccgcggtgagcatgctgaaaatacattataccaaattctaatctcttttgttttggtttaatttggtggttgtttgtcttctcatgattcacttggctatcagtttaatgtttattccacctgttttgtcttactttatagggcagccaaagcgacatcttctcacaactggatggagcatgtttgttggagcaaaacgccttagagctggtgactctgttctatttatcaggtattgcaaaaataaagtaatgaaagttgcagcttcatgaattattcaatgttgagaaatatgtgcgtataaaatttcaaacattctgattgtaagcaaacaagagagtatccgttacgtggtatattttgaattttactgctgcagggatgagaaatcacagttgttgcttggagtcaggcgcgctaaccgtcagcaaacttcattgccctcttcagttctgtctgctgatagtatgcatattggagtacttgctgctgctgctcatgctgctgctaatagaagcacattcacaatattctacaatcctaggtatgtctataacggcagcttccattttcatacttcacatagctgtgagatttgcctataactagatgcttattttctacagggcatgcccttcagagtttgtcattcctttggccaaatatagaaaatctatttataacacacaactgtctgttggtatgagatttggaatgatgtttgaaactgaggaatcgggtaaacgcaggtatatctttcatgctgggaatttgtgggacaactttctaaaattaaattctgattatagatcttcttcacttcatctgactttgaagtcttttcatcctctctttcagatatatgggcactattagcggaattagtgatttggatccactgagatggcctagttccaagtggcggtgtcttcaggtgattaaaatttcacactgattgcagcttattatcatgttttcctaaatgtgagctaattggcacttcacagttttctatcaaattgactggacttatataacaggtagagtgggatgagcctggatgtggagacaagcagaatagagttagtccatgggaagttgagacaccagaaagtctcttcatatttccttccctgactgcaggcctcaaacgaccttaccagtctacctttttgggtaagttgatccttacttcttcctcatttgattaactcaaatttgtgatagttttaacttttgattaaaacaggagcacaaactgagtgggacagtttgatgcagcaccgccctttcatgcgtgttcctgaaaatgtatatggggatcttcagagctcctctatctcaaacctatggtcagaacagctaatgaagatgctgataagacctcctcctggccttactggtcttcaatgcggtgttcccacagtacaagacattaaggttgcactacctcaggaagctaggaatgtagtacagccagcaggaaaccaaaaacctgagctaataactgtagaagctacacctgcacaaagtgaaacaaattcggaagttgtccttaatcaacctgttggtgttgtgaactctatttcttcacagcaagcaactctgcaggcgaagtctaaacctccggaaaaagtagaaactgacattattggaaaaaattccgagccaagaaaagaaactagtaattcatcagttaagttagatcagtttcagtgtaatgaagacaaagtggctatcaagcctgcaagtccccatgatcttccaactgatgcgagtgtgacagcttcccaccataacagcttttctcaattacaagctagtccatggctcattcctcataaccctcaaattgattctgctgcttccaacaatatccttcaatgcccaactaataatgagtggaatatgtcctctctccaatctgctgctggattgctcaaatatcctgtgtcgacctccactttgacaaagcatgataattcttttatgttgcctgatacaattggtcatggattagctccaataggccaggatttgtgggatcatcagttgaatgatgttaagtgcttttcccagacaaaccttcaggttccactagacataactaacatgcagttcctacctgattcttatggttttaaggacctgtcagaggagagccataaccaaagtgatatatatagctgtcttaactttgatagtaacagcgggagcacagtgattgataattctgtttcgagcacagtgttagatgagttctgcaatttgaagcatactgatttccagaatccttcagattttctattaggcaacatcagttctagtcaagatgttcaatctcaaattacatcagccagtctggcagattctcagaatttctctgtacaagaatttgctgacaactcgggtggtgcatcatcaagcaatgtaaattttgatgaatgcaatcttttgcagaatagctcatggcagcaagttgctccacgtgtgcggacatatacaaaggtaagcgctttatatgttgtagctatgttatatcaatcttagtagcaaggataatcctgagtcgataggtattatgctcatgttaactcattactttgagttatagaatcttctttgtctctttcggttatttcaccacttctttttaagggttccctttgcattttcataacatgtccttgcatatgcaatctttatttgtttatctgtttatatattatccatttatttactgcgaaatagtcacttttgtatttcaatgttctatatgtaatctgactggatttactggtgaacagattcaaaagacaggatctgtaggaagatcaattgatgtctctggtttcaaaaattatgaagagctgcggtctgaaattgaaagaatgtttggacttgaggggcttctgaatgacactcgaggctcgagctggaagttggtatatgtggattttgagaatgatgtcctccttgttggggatgatccttgggagtaagttctctttgacacaaatctctctcatattcaggttgcaatacgaagcgcatactatgcatttttaactgtagatcaataacttcacaatgcataatccagaaacaaactcagtatgatgatgttcaactaatatctcttgaatggtcttgcagggaatttgttggatgtgttcgatgcatcagaattttatcgcctactgaagtccagcaaatgggagaggaaggaatgcagctactgaactctgctggactgcaaagcatcaatggatcaacatcagaattcccaaactaagctcaatacaagtgatctatgagagctcacagtgattgatcactagagttgcatggagcaacatgcaaatgtaatgttgttgaacaacttaacaagaagatgattcactaggtttctgttatagtagtgttgtaatttatgagtgttgatgactctgtaagaaaacagctttagcatattaaactatgccttccacatattagagttgttttcagctgcatcttgtttgtcttacaaggctgtttcttaatggagaaagttgctatgacttggaaatgaaagtacaatatcttgcattttttgtaagacggtgatttcatagtttgaacttatgatcacttgactatttttgtaagacgttgatatcacctccttgataatatattgtattagcaaagtgcaagcaaaatattacgacacgttaaaaaaaatatatattaatattgaaactcgattaagatacgataaaaaaaatatatattaatattgtaagtgagtactactactttctaatttttgaataaatattgcctcaatattttattgtcttttgggtggcacaaagagccacataatcgaaatgtatataaatcttattaatacgtgtcaattctcaacaattccttgatgctttgaacttccaatcttccaccgacgacaaccggcaaaagggaaaatctgtctatcagacttcagttaagcttgaaatgggtcaatcttcatcggccgagcaagtgtcgccggagcaacgggaagcagaatctgtagctgcttcaactggagctcttcctaatcttaagaaagctttctctgttctttctgatcctcaaactcactccatctccattcattcccttcaagtaattcttcttcttgttccgcacgtaaatttttttttttgcttatctttgctcaatttacattttgctgacattgtttgaatcacctacaactggggttttagcaaaagttgaaattttcatggaatttatggatttcccgaactttaaacttttgcttatctgtgctcaatttgcattttggtgactattcttgaatcacccacaaatggggttgtagtaaaaactggaatctaggtggaatttatggatcttccgtttcagtttttgagttattttttggttgttttaagatgtttacatttgagagactttttttgcataaaccacaagtgcttttgtggcaaaagttgggactttcatgaattttctgtgtttagttatttttttgagc

SEQ ID NO: 280 - DNA, 2614 bp, Solanum lycopersicum
  modified_base (1)..(2614): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 281 - DNA, 6845 bp, Solanum lycopersicum
atgataattagtactttttgactttcgcacgctttcactttttaatacaataacgggatcactcctaagtcgtaacataaatgtcaccgcatctaacacttaaatctaatatcctctattaagactaaagaaatccaaccattacatgataattagtacttctcgagtttcgcacgcttttacttcttaacataataactgagtcatttgtaacgtaaatttctccacatctaaaactcacatccaatatctttgattaagacttaagaattctcaccgttacataataattaataatcttgacttttatgcaatttttacggtagttgttccaccattgcttgacaggtggtgttaactttacttagttaataaccacccgttacttacccaaccaaccccccccccccccccgcacacacacttaaatccaaggtccccgattaaagactaaagaaatctcgccgttacataataattaatactcttgactttcacacctttttacttcttaatacaataacactcgtaacgtaaatttttccatatctaagatttaaatctaatgtcctcgattaagagtaaaatctcttaccattacatgataattagtactttttgactttcgcacgcttttactttttaatacaataacggggtcacttccaattagtcgtaacgtaaatatcaccgcatctaagacataaatccaatgtactcgattaagactaaaaaaatccaaccattacatgataattaacacttctggactttcgcacgcttttacttcttaacacaataatggagtcacttgtaacataaatttctccacctttaacactcaaatctactatctccgattaggactaaaacaaaactcacggttacatactaattaatatgtttgacttttacacaatttttacagtagttattccgccaatacacgaaagcggtgttaactctacttctaaccaagcttataaaacccaaccaaccccccactctacttcacactacacagatgaaaaaaggagagaaacacgttctctgcagggagcggtagaaagcaacaaatcaagccatatattaagctgtttttgggtaaactccgttacagagttttctctttctctctctcactttctctctttctctcacatacaaaatagaaagaaaaaaaaaatgaaattattaagctgttgcttcttctgttgttgctcctgtttgttccagtagaactagtactactattgttagttaatttttttttatattcagcactactttaaactttatttttagttgttgggggtgtttctttaaggcttttttatgtgttgttgttatagcagggaagaaatgtggtgaattttagctagttttgtgatgtttttttgagctaattacttgattttgaattctgggtgttctttagtttttggaattgaaggttgattatactcatggcaactataaatgggtggtgttatgagtctcagccgaatatgaattctccaggtgaaagtttgattttttgaagtttaatttgagaattttggagctttttttgttttttttgtttaaaatgtggattttttattttttgagtttcaggtaaaaaagatgctctgtatcatgagctatggcagttgtgtgcaggtccagtagttgatgttcccagggaaggagaaagagtttattattttcctcaaggccacatggaacaagtaaaaaattttattttaaaaaaataattgaattctgtgttgttgtttttttctgttttaggtgaatctggttgattcaaggctaagttcttgtttttgagttatggagttgtgaatttttattgaatttctcaatttgagtgtatatttttagttatgttttctggggattgtaaaatctgtatctttctctttttgtctcactttttttggttttgtggaaaagttggtagcatcaattaatcaagaaatggatcaaagagttccatcattcaatctcaaatcaaaggtcctttgtcgagttatcaatagtcatttcctggtatgtttatatttcattgtgttatttgatcagtttattttacatacattgtattcatacttgttagtaattcatccaaaaaaagtgatgaatttattgttgggttcaaaattcaaacatcggaaggtgagccttggcgtattcgtagctggcaaagttgtcggtttgtcgccaagtgaacgaccatgaggtcaccgttcaatgcgtgtaagcaatctcttgcagaaatgcagggtaaggttgtgtccaacagacccttatagtccagtctagcgggagctttagtgcacctgaatgcgtgtaaagttcatacaattttgtatttgaaatgtaaaatgtttttgatgattgcttgtaggctgaagaagacaatgatgaggtctatgtccagatcactttgatgccagaggcaccacatgtaagaagttaaaattgttgtagtattcacttgtttatatgcattttattgatcaatttggttttaattattgatctgatttttaggtacccgagccgactactccggatccattaattccgcaggatgtaaagcctagattccattctttctgcaaggtcctgacagcctccgatacaagcactcatggtggattttctgttctaaggaaacatgctaatgaatgccttcctccattggtaatataagtgtgatcattttgtataggctagactacgtttccccccctgttttgacaagttgttgaattagctgtcgtgtttgttatactttgttaggacttgaaccagcagactccgacccaggaattgattgcgaaagaccttcatgacgtggagtggcgcttcaagcatatatttagaggtaattgttttgtttgtagagtgtaacagaagatatcaatgaagctttatcatgtattgtaaaggtcaaaagtcatccgtctttgttttaattataacaggccaacctcggagacatttacttaccacagggtggagtacctttgtttcttcaaagaaattagtggcaggggattcttttgtattcttgaggtatctctctctggtcctagcttctcgtatgagtatgatatttgattgcattgtctatcactattgcatgtcatgtcatatatccagaacagttaatgttggtttgttaataatcatattctaatggatatgtacgctctaggggtaataatggacagctgcgagttggggtcaaaaggcttgttcgccagcagagctcaatgccgtcatcggtgatgtcaagccagagcatgcacctaggagtcttggctacagcatctcatgctgttacaacccagacaatgtttgttgtttactacaaaccgaggtttgtcacatacacctcctttcaattatcccgtcatccttacgcagtagagatcattttcatgccagagaacatactaaatctttcatatgctcttccaattttctgctttgacaaccttcagaaccactcagttcatcgtaggcgtcaacaaatacttagaggctcttaaacatgaatatgcagttggcatgcgattcaaaatgcagtttgaagccgaagggaatcctgatagaaggtagtgatatcaattactcgctagctccattttgatttatctgtcttactttcctttatagtttgtttaaaagaatgcatctttccctttttggctttaattcaacttaaattccgtgccaagttaaaaccagcaaataaattgaaatggtgggagtattcagaagtcctccaattagatgtggaagtctttgatcaagatgtttatttgccaactgcttagttctgacatgtatttgtttgggctctcccctattatttctcagatttatgggcactatagttggaattgatgatctttcttcacagtggaaaaattctgcgtggcgatccttgaaggttgatatctacatttatatttcagcaatattctttaagttcaattggaaatcaccaattctcccttcgttccaggtccgatgggacgagcctgcagccattgcaaggcctgacagagtttctccttgggaaattaaaccttatgtgtgttcaattccaaatgtccttgtcccaccaaccgcagagaagaacaaaaggcatcggctacatagtgaaatcaaaatatcaggtctgaatgaaaattctcaacagcatggtggtttttcatgtgttggttgctgatattttaatttccattttcattttcttaattatcttgcctttcttttcctgttagaacaaccttcatcctcaaatgcttcggcggtttggaatccttcccttcgatcgcctcagtttaacacctttggcatcaacagcagtactaattgcgcattagcgtctcttacagagagtggttggcagcttcctcatttaaatacttcaggtatgcttgtggatgagccagaagacggtaggagtgctccaacttggtgtggttttccatgcgttttggccccgcagttcggtcaagggactaatcagccgattgttattcctactgatgggagaaaatgtgataccaaaaaaacctgtagattatttggtattgacttgaaaagttcctcaattagcactactgaggcacgactacagctacagccagccggcatttcttgtgtctttgcagagagagcacctccaaacacggtgcctgctggtgattcagatcaaaagtctgagctttcagtagacttcaaagatcaaatgcaaggccatttgcggttacccctaaaggaggttcaaagcaagcagagttgttccaccaggtctcgcacaaaggtattaaatcaaaagccaaaaaattgcattcttaccaactcattttcgccacaaaacatattattaaactctctaacatcttttcacatgtggaatcccttgagaaggtgcaaatgcaaggcgtagctgtaggtcgtgcagtggatttaaccatattgaaaggatacgatgagcttacaaaggagcttgaggagatgtttgaaatccaaggagagcttcagtcacgacagaaatgggggatcttgtttacagatgatgaaggggatacaatgcttatgggtgattatccgtggcagtaagttctctctcacttaaaaaaatttaagactgaatacatatacaaccactgcataagatcttttctacaacctgtaatttaacacatcacttaaatcacttaattgcagagacttttgcaatgtggtgaggaagattttcatttgttcaagtcaggatatgaaaaaattgaccctgtctcgcgcagacagttaagcagctcctttcaaatgaaatgatggcggaagatggtgaaagttaaagactccgccttttgaagtggtaccgttttgtgatctctttggcttcattctctatatatagtaggaaagaacgacaggttgttgacatagcaaggcgtagaagcttgtttttacgctctttttagcctagtgcagctccgttttgagagcagttaagtaagtaactagttataataggataagactagtaaaaatatagtactagaagtagtaaaaagttaagggtgttctctaatggggagtctatatagtagtagtttatgtagttttctattcgcgcgttaacctgtaaatactcatgtgccattgtagtattctggaaatactacaatgtatggtcttgttaacgtgctttatgccttatcttatatgaaaactccatggtggagattgctctgtacttgctctttctgtatgacttttgtgatgcacaatagggatttcttgtctaaatttagactcttttggcacaatcatgcatcactttgtaactttcccctttactgaacaaaaaaatctttcaaaacgctccttcgcgtgtgtgtttgttttattctttgctaaagggtgatcctaacatttaaattagataccgttttctttactataagggtgacttgaactcaaaacctgttttattagtatgttactctatttagaagtttaataatttattagatatgacatttctatttaccttgctatttcttttaacaatatttacctttagatttatataagtttttgattcattaactgactttggttaagatgttgagtgcaaaataaatagatggttcatcttttgagctagcgtagagtcattttcctttaaactttataaagcacttacaatcacatatttgtgcattcttagtgcacgtttgaccatggataattttcactattttatggaactgtatattataatttttttggaattagaagaactcaaaaagactcttttcataattttattccgaatcactcgtacaaaaatcaaaaaacaatttcaagttgtattcattttcaagcaaaagttcaatttgtcactatcacttgtaacacaaatattttccctttcgaatttcacaattttaatattctaagttcctttttgagaacttttagtgaaaggaaaattgggctttgtgaattgtttggtcttcaatatccctatcctagctaggaagagtgtccatatagtcatgggcctcatgagttgtcaaatgttacgtaaaggtatttatctttgcatgagtgtttggtcacgctcaaaacttctttattataagtctgagtctttgtgttatgtatccatgcttggcttgcatgatgtttgtgtcattcctaatcttattgaatggactataaaggacttagtcaagtataactataaaatgacgatagcttatagacaacttcgtagttgttggagtatacaacacgctgacatc

SEQ ID NO: 282 - DNA, 2969 bp, Solanum lycopersicum
ggactagctcgattttaatttacgtggtattttttgaattttatttatatattttaaatatttcgaacagtaagttattgtacatatgttattttcttaagtaatttttaaaattgtgtaaattttatttttaaaacacttaaaaatttcatgctcgaaatcactaacaaaataaattattggataatgtataagtacctctcaacttataccagaaatcttagagacacacttatactatactaaggtcctattaccctctgaacttattttattcataattttctatcctttttcggtctatgtgtcattatcttgtgggcccaacgctatttaatttttttttcaaactagtgccacgtaggtcaaaaaggggtagaaaattactaataaaataaattcaggggataataagaccttagtatagtataagtatgtctctgagatttcggacataggttgaggggttacttgtgaattttccctaaattagattctaaaaaaaatagaaacgtgtcatataaattgaaaaatgaaaagtactcttttataataaatataatgtcttaaaaatatgaatgggaaatgagtaaataattataattaatgataaatataaaataggagaataagtgtaaaaatatattttaatttcataaagtgaacaattactgttggatattttaaatagtacaaaaataactactgttagattgagaaaatttaacaagagtatttcatctctatactcgtactaattcatgtgtaattttggatgaagattaacataattatatttgatcgaatttttatttttttttaacgcaacacaagtaaaaataaacggattcaaaaagttagcgagtactttgacaaaaagttagtgagtagttttctttttcttctataaataaattagacttttttccatccatttccaaccgaaaacacaacatatccatactctgttttttctaatatttgcactctgttttcaaccatggcagattccgacaacaacaacgacattgtcactgatttcttcccatactatcgactctacaaagacggtcgagtagaacgtttctacgaacttggtggtgtacaccaagttccaccgtcgctggaagatccagcgactggtgtatcatcaaaagacgtgagcatctctgctcacgtctccgctagactctacctcccaaaaaacaccgcacccaatcaaaaactccccgtcctagtgtattaccacggcggaggacttgtattaggatccgcatttttcaaaacagagcattgttatctcaaccatctggtttccgaatcgaattgcatcgcgatttctgtagattaccgtcttgcccctgagcatgacatccacacaatctaccaggattgttgggatgcacttcagtgggttgcgtcacattctgtttctgatacaattaacaaagaaccatggatagaaaatcacagtaattttaaccgactgtttgtagggggtgacagtgctggaggcaatatagtttataatatgatcatgagagcggggagagaaaaattgatcggagatgtgaaaattttaggtgcaatacttggatttccttatttgatgataccatcgattgaaaactatgacaaaggaatggcttacaagctttggaatatgatttgcccgctctctgagcggggaaatgatagtccaatggttaatccagtctcgaagaagtgccctagcttatctaagctaggatgctcgagactttttgtgtgtacgggagagaaagacgaacttgtccctggagaagttgcgataaaattcgccgaagctgtgaagaaaagcggatgggaaggcgaaattgaatcgattatagttgaaggtgaaggtcattgctttcactgtgaaaatcctcaagctgaaaaatccaaagatttgatcaaacgtatagtttctttcatccaacgtgattaacatttgtttttacaaattattattatttgcactcgtaacgagtttcctcgagaaacaatctatctatctctatgagatagaaataaaatttacatatattctatctttcatatcttaaattaaatatctttcgataaacatatgtaatagcgtgaatattttattggtagtgttctgtggtgtagataaattgttagaagctataaagtgtttaatatgtggtatagtagcaaacagtccatgtgataaatgaacgagtcatatccaccttttatatatatatatatatatataatagttcatacataaatcaaaaaactactcaatttttataaactccaaaaaattaatagtctttgtgagaaccactgtcacacaaataaatatttgtgtcaactacgtctcaaaataatatagtgaataattattatcaaacgacacttgtgttgggttatcaaattacaagatgtttaattaatatcataagaagacaattttttaaatgtgattttgcatgccatagtttaagcatcctaattcataattaagcgccattttttatgcctacttctatttaaatactccctctgtttcaaaagaatgtctctattttctttttagtttgtttcaaatataatgaccccttttctattttgataacattttaattttaactttccacgtgacatgtttaagaccacaagattatagggcattttggtatatttgacataactttaatttagaaccacaaaattaaaaagtcttatttcttttcttaaactccgtttcaagttaaactaggtcatttttttgtaaacggagaaagtacaatttatatagggaaaaaagtctaactatagtatatggttaccctaagggaaaaaaaggtcatgtccaatacttactaattagtttgtttgattacacctttttgcaattatttatatttgaatctgaataaattatatatttcacgtaaaaaagtatcacaattgga

SEQ ID NO: 283 - DNA, 3164 bp, Solanum lycopersicum
caatataatggataagatctgtgatctttttatattggattgatcaatatatataaagatatcatcaatttaatatgtatattttataaaattttacaagcctatacatgtgaatacatatatctataaataagtgtgtgtcatgagagattgatttataatctatttaaatttaataattttaatatttaaccgataacaattttaattttttttaacaacaaaggctctctcaaatatttataaaaaatatatgttgaagttgaggttcgactggtctatcttaaaaaataaacagatcaatatattccaaattttaaaataatcctggataatatgaatcttttgaattttgttgtcatttttattctctttttaaatttaaataacgagattttaaaaattaaacaaaatgtcttatttagtgctcaaaattttttctacggagattgctcatttgaccatccttagctagatgtagctccacccttgtctcaagtcctctagtacctatcttagttggttaatttcaaggtactatcttgatttttataatattatcttctagaagtatatatttatcgtgcgtttattttttaattatattctttacatttttaaaacgtcaatttttatatagcaattttagaatataaacacttaaagatctaatgctcaaaattagaattgaaataaaattatttgacttttgaaatttgaaatttaaaatatgtcatacagagtaagatagagattttattctcttagttcacttttattttttcattttcaattttttatatatttttgagaaataaagattaacatgaatattttatcaaatacttcatactaaatgatgtatgatcttaaatcttaaaagtcatctgaaaaataaataataaatgttgaaaataaaatattaaaaaaaatagacagagcaaagagtgactttttttctctatatagactacattatgttccattcatctccaacttaaaatacaacattttttctaacatttgcatactttgtttcaagtatggcctcttccaacgacaacaacaatgatgttgaaaccgatttctttccattctatcgcctctataaagacggtcgagtagacgtttctatgaacttgctggtgtacaccaagttccaccgtctctggaagatccagagactggtgtatctctgctagactctacctcccaaaaaacaccgcacccgatcaaaaactccccgtcctattgtattaccacggcggaggatttgtattaggatctgcatttttcaaaacagagcattgttacctcaaccatctggttttcgaatcaaattgcatcgcgatttctgtagattaccgtcttgcccctgagcatgacatccacacaatctaccaggattgttgggatgctattcagtgggtcgcgtcacattctgtttcagatacaattaacagagacccatggatagaaaatcacagtaattttaatcacgtgtttgtagggggtgatagtgctggaggcaatatagtttataatatgatcatgagagcggggagggaaaaattgatcggagatttgaaaattttaggtgcaatacttggatttcctcttttgctaataccatcgattgaaaacttcgataaaggtttggcttacaagatttggcataccatttgcccgctttctgagggggaaaatgataatccaatggttaatccagtctcgacaaagagccctgacttatcgatgtatgttagggtgctcgagacttttcgtgtgtacgggagagaaagacgaacttatcctagctgaagttgggacgaaattcgtcgaagctgtgaagaaaagcggatggaaaggggaaattgagttgattgaagttgaaggtgaagttcatgcctttcagtgtgagaatcctcaagctcctaaatctaaacatttgatcaaacgtatcgcttcttttatccaacgctaagtgattcatgtcttatttatatttccgtaataaaaataagatctacgtatattttatatcttcagattactgtgttattgttgttatgatatactattaatattgatttttctttatcttaaattgacgatatgtaatgcctacagtaatgatatgtttgctattgtttaaaaaaatataaaataagagagcaaatcagctttattttgagtttttaattatgaggttataatgaagttgagttcctttattttaaaaagatgaatattcaatgtcaaattgttttaataattatccaagtgaaatgtccatttaaacaactaaccatgggattcgaaccctagtttagactttagagggttgatatctctagcttctatcaattgcacaaagacatatatatatatatatgattttatgggtgcactgttaaccatatctcaatttctatcaatttctctctctctctctatatatatataaatttttttcgagagttaccgaatatacatgcacccttatcgtatagtgtgggtctgatagcaaacttgctctatgtaaaggtccctgcccttggaaagattgtgtcattacaataagcttatttatctattaacaaaggtgtattcacgatttgaagtttattatttcgaaatataatcatttgagtaagtttacatatctatgtgacttataaacgattttaaatattttatttaatttttttttcactataccaaaagaagttgtatatattgtattttttattttattttctgttatcatagctcattgaattgtcactaatatagacataaaaatagaggagaacaatttgaatcctaattgatgtaatttgtcaaagttttatgttgaaacttgaaataatcgttcatcaatagaatacaattttttttttaattaaaaatttcaaattcgagctcaaaatataaattattttaatttgtaaaggagtgattacatccaattgtgatacttttttacgtgaaatatataatttattcagattcaaatataaataattgcaaaaaggtgtaatcaaacaaactaattagtaagtattggacatgacctttttttcccttagggtaaccatatactatagttagacttttttccctatataaattgtactttctccgtttacaaaaaaatgacc

SEQ ID NO: 284 - DNA, 4745 bp, Solanum lycopersicum
tgccacgtgtccaatgacgaatagtaaatttttttaaaataataatgcctaattgaagaagagatgacaattaaatgaaaatattattatacttttatttagtcaattaacactattggaaagtaacgtcgataacaataataatatattcagtattatattattgagttttttttaaaaaaaatttagacttttatatcaaagatatatgatgattgattaaaaaacaataacaaatggttattaaatattattataattaaattatataaataaaatataatagaagagaaaaaaataagagtaatattaagccccggacaaaacaagacaacaagtccatacactcccgagtctcatctattaaccttttaacatagttaatatcttacacgctttactatttaggtatacgtctttgataaattgtaatattatcgtgttttgtttaattacttcataaattactattttttccgcctaagtactctactttttttgaattcgttcataatctagacctttcatatctccatatcgatgcattcgtgtatctgctcatcacatactccagccatctcgatattattttccgtatcttattttcctccgactctatgaagttaaaatcaaatctttctgttaactttctcaatttattcgtgaataataattcacggacgtgaagtaagtaactctaaaacaccttatcgctccattactcttcccatacttgagctacatgaaccttcacgcgtctccaaatatccaccgtccatttcacgtgatcaaaagcaatcttaaccgtcgcctccgccatcgctcgttcttcgccacgtgtagttacttacacgtgtcattaatttaacggtcctatttatctttatatatcttattatctagagtttctattttttatttttacttgtatactctataaataatccacaatttcaactcctccttctccatttttctccatcaatttggtgaacaaaacaaaaaaaaaaattaaaaaaattcatcatttttaatctgcaaaaaaaaaaattagttataatattattattattatggcaatgagtctgccacaccagatcggtgccttatcaggaacatcgctcacggcggaaaccggtggagtttcatgcgaagttccggcgaaggggagttcagctacatcagctatgtggagaacaccgatgacgaatttaaaagtatcggtgcaaaaaacaggaaatgaaattgacagggtgtcgccgtcgccgtcgccgccgatgagtccgatgatgggaggaggaatgcgaccggatttatcggtagcgtgtcaagcgttgatggaggctcaggtagaggaggtagttgagagagaatataaggttaggaattcgtcggagaaagagaaaggtgttccggtgtttgttatgatgccgttggatagtgtgaaaacggatcatactgtgaatagaaaaaaggcgatgaatgcgagtttacaggcgttgaaaagcgccggtgtggaagggattatgatggatgtgtggtggggattggtggagagagatgcaccgggagagtataattggggcggttatgctgagcttatggaaatggcgaaaaaacatggactcaaagttcaagctgtgatgtctttccatcaatgcggtggtaacgtcggtgattcctgcacgtatgtatattttctccgatgctatttttaattcgttttaactgcaaatttgtgattaccagattcaaaatctagatctgttataatgaataccgtcaaatcaaacatgatataactcgcatctcaaaagctaattcgagatattttcacatcggatgtggcctgactatcataacatgtcaaattagtattttatcgtagtttaacctcacaaaaagctaacttaaaagggagaagcattgctcgaaacgagtggagagatatcattcctcgtcgaggtggtaaatctcttcaacaaatacttttagataaaagattcataggatctggaaaagattaaagaagaaagttcaaaaaaaggttagtggatagtgagaatatgctcctttatatgtgtgctaaatgaactatttaaagtaactatattttatctggaaagataaatgactttataatagattggaatcaacctgaatagcataaaatggaatatggaagattcatgaataattcaattatctttgtttaattttcattcgagttctgttatgcgttttgatttctactaatcgcgatgtataggcgttgcttaagtagatttttgaaatttcaggatccctcttccgaggtgggttgttgaggagatggagaaggatccagatcttgcatacacagatcagtggggaaggaggaattttgaatatgtatcgcttggttgcgatacacttccagttcttaaaggaaggactcctgttcaatgctattctgatttcatgagagggtttagagatagatttgagaatctcttaggtgataccattgtggtaagtgctatgtttttttcgaatttttgatcgaagagtagaagactcacttttttaatccaaatgacgtgtgatataggaaattcaagtcgggatgggtccagctggtgagctccgttatccatcctatcccgaaaaagatggaatatggaagttccctggaatcggtgcttttcagtgttatgataaggtataaagcaagttctgttttctatggtgtgttttagtgtttaacgtcgtcattattactgatgatttgttctgttaaatgtattgtatcgcgttgcagtacatgatcggtagcttacagggtgcagcggaagcatttggtaagcctgaatggggacacaccggtccaaccgatgctggtgagtacaacaattggccagaagatacaaactttttcaagaaggaaggtggtggatgggatagtcaatacggggagttcttcctcacttggtattctcaaatgcttttgaaccatggcgagaggatactgcaatcatccaaggcgatattcgaggacaaaggtgtgaagatttcagttaagattgcaggtatccactggcactatggaacaaggtcccatgcccctgagttgactgctggatactacaacactcgtaaccgagatggttaccttcccatcgcccaaatgcttgcccgccacggtgcagttttcaacttcacatgtgttgaaatgcgtgaccacgagcagccacaagatgcacaatgtgcacctgagaagttggttaggcaggtggcgttagcaactcaggaagctcaagttccacttgctggggagaatgcattgccacgatacgatgattatgctcatgaacagatccttcaagcgtcctcgttgagcatcaacgatcaatcaggtgatagagagatgagcgcgtttacatacttgaggatgaatcctgacttattccatcctgataactggagacgattcgttgcctttgtgaagaaaatgaaagaaggaaaagacgctaacaaatgccgcgaacaggtagagagggaagcagagcatttcgttcatataactcagccgttagtacaagaagctgcagtagccctaatgcactaagcaaatcgttgtcaaatagtactgttttaatttgatccttttagctaacatgaagtttttcaacatgttacctggatcttatagctcgttatcgttgttcttaaatgtttgtaaaactgttcatcgtgtagtttttttaaagctagacattatgtcttaatgaaatgatacataattcagtagtaaatacacctcttcaatccaaatatcacatatatgattcttcgttcatttgttgactggttgatgttcgttcgttcttaattttaaaataactggagaatcaaagatacgtctttttatacttattataaaaatttaaattaatcgagacggtaaaaagtttaacattgttgattgttacatgattttcctatactttggtatgacatttttttatatgtcaacccataccttctaagcacatgatacgtgcacaaactcgagaatttattttgtactttgctttaagtaatggcaagtattcatgtccataaggtcttcatgtgctagtgaagtctcttttactttaaaaaaatcgttacgttgctatcggagatgaattcaaaattttaatttttacaatctattatttgtattaatctaacgtgttttactacacattaaagccaaaatttctagataaactcactcgttacattataaatctgcattgatagtgattgttgttaaatatgatacgtctgtctaaacgtcacatattatgtttaaaaaatctattttttgttacttaatatcgtgtctaagttttgtggccaagaagagtcataaaaaagtgtttcacacggatttccattataaagtaataagacaatttataatagctgacttttaattttatttcacacgactcttatgcacaaaattataaaaatcgtttttttccccgtaaatatacatacacactatttcaacgtttaattatattaactttttttttattttcttaaatttcgtattgaatcgtcgtcacatacatgcatataaagtaaagtagaagtggacattaatgttcaataagatggttaaggaccatgtaaaagttaggtataaattttttttccttttgttttgatttattgtggatgagagggtctgaatattctagtgtatgtta

SEQ ID NO: 285 - DNA, 3743 bp, Solanum lycopersicum
aaccatgaggcacttacattccacatgagtatccttttaattgtgtataaatggctaataatttttgttaggtaggtgtagtattctactaatgttatataattgactcatgtaaataaatctaattaagataagctctagaaaaaatggagtctacctagaaattattagcctattgtttggaacatgtcaaaataatttatgtgatcccaactaattagccgtcaattagtcaattaattaactttattttatatcaaacttatgaaactcttggggatttcttgaagtttaagagaaagactacttacttaaacaaacccaaaagtctatgcattattataaattgttatacgtatctggttcaagttttgagtatagaaaaaaattcgcaatgaaatatatttatgaataaaattagaataccgaattattaaatagcttatgtaaagttaaattgttttttccatatttaaaacatagattcaaaatcttaaaactttattaaatatttacttttttaaaaaaaattatattttaaatatcacctcaataaaaaaattctagtttcatcaatgagcgtaattttctccttatgatagctatgattcacacaattattcatttattcgtaacgtaatgctatcatacatatcgaattatgactggacgctattaaaatcaaatttaaattaaaagtgatctatctatcgcaccattcatgatctgaattaatcgaaccagtatataagaaaatccaatcaactaccactttttttttctttacaagagctagagttcagcaaaagtaagttaaaaataggtctgtccttttgactttgtaattataaatatatgacttaaaaattttcaaattttcttcttttttactgttttaaacccaccccctacccccaccccccacccccacccccaccaacccaaagtcacctcttattatttaatataaatattagctataccatagagactcttgtccatttgtctatatatctaacaaaaaaaaatacttttagtgtgtttttaacaaaagaaaaaatgggaagagctccatgttgtgataaagcaaatgtaaaaagaggtccatggtctccagaagaagatgcaaaacttaaagattttattcataaatttggtactgctggtaattggattgcacttcctcaaaaagcaggtaattattaatcgaacgtatttatcgaaaacagtctttctattctgtaaaggtagggaaaaagttacttacctgttataattgtaagtactttagacctatttatgtgattatactgaatatgttattattattgttgtagtcggaaaattgttttttttttatggtattaattgtttgaatatttttttttcaggactaaggagatgtggaaaaagttgtagattgagatggctaaattatttaaggcctaatataaagcatggtgatttttctgatgatgaagatagagttatttgtaacttatatgccaatattggaagcaggtaatttatttattttgataattttaggtttctatgatgactttgagactaaaaaaaaaaattgttcccactaaaaatggggaaaaaaaagaacctcaataaatgtgaaaagggaaaaaaaaaatgtatataaatttaaattagggttcagaaagaaatgcaattagtttgttggatttttttaattaaagattcttccatttttagacaatttttttctgcatgcatgacagggtttagatctaagataaaatctttatttatttgatttatttcaaccccccctccccccaccccaccctcccatagtgtttatgtttacgagagatttgattttagatttttagagaagatcgttaatttatttatttttaacgtgtacaattatgttggtaggtggtcaattatagcggcgcaattacctggaagaacagacaatgatatcaaaaattattggaacacgaagctcaagaaaaagctcatgggattaataatacctaataacaattcttcttcttcttataataataataataataattaccaaaaaaaattaccatattttccatcaacttctcttcatcaagcccaacaaaatcttgggccttttattacaggcccagaacagcccattattattccagcagcccaacaaaacaatttgttcaccaataataacaacaacttgatgatgatagccaataatttgcaaaattatccaaattttggtgctacaaattacaatttgcaaaattatccaaattttggggaagttgcaagttgttcttcatcagatggaagccaaatgagttttggtactaataaagatattattaatattaaaagagaagaaattatgagttttggtggtcatcatgatggtgctatttatgaagaaattaataataaccaacaatttaattttggttattttggaaatactatgcaggagattgctacaagttgttgtaccaatggcaatagtggtagtactaccaatagtagtaataattttttgttgtacaataatgatgaaaattgtaacaagtcaaatgagatagggatgttttattactaaaaaaatgtaagtacaattatggaagatttgatagttgtgttgggggtatgggggttattgccaagtagattttggactttttttcgggggttttgtgtagctctatttttgtcagaatttaatgaaaaagaagtttttgatttcattttatctgttatttggtattttatcgtgatattctgattaatttaaatttatatgttgtaagaattttttttcttcaaacttgatatatggtacttgttttgaaaatgtcttgactaatttgatatgtataatgcgtcatcgtaaaactcatttaatgttttgcatagctacttattgaatggaacaaaaaaaaatttcatttcgccttatttgatatttatcgtgagattttgattaatttgaccttatattacgtaagactttaagaaatctgatgatgatacttgttttgagtcatgtttatttcgatttgcattcaataaaactcatttaatgttttatgtagctacatgttggaaattgaatggaagaattgaaaataaattttttatatcatttcacctagtgtttgattatttattttgatatctgattaattcaaattacgtaaaatctttttcttttgaacttgatgttttgtacctgttcagaacaaatttaatttacatttcgtaaaatctctttcagaaaaagaggatatttttttttcactaatggggcaatttagcatatgttgattatctccgtctttaaaaaaaatcaatttaaaggtattttgatgtataaagtttgttaagggtgtgtgatgtaaacaactagtctattctgatatgagcgactaattttaccatataaatttatgatttaaatataaatttttttatcttgacaccaaaacaaaaatataacttgagattttcacctatagattcaaacgaaaaattaaaaaaaaaaaaagactcttatatttttattagtttatttagtgtaacaaactatagagatttaaataatctttgtatgattagaatgagtcattcatatagaaagatagatattaataataatacatggaaatatatatttggggatttgcatggtggttcaagatttgaaagtgataaatatattaattaatcaaaatctcagtgttatt

SEQ ID NO: 286 - DNA, 5735 bp, Solanum lycopersicum
attatttgtgcactcatattatatattttatagtataattaggcaataggaagttgtcttccaattaagaaaaagcaagaagcataaatggcccaccaccttaattttgtaaatattatattgctagtaagttacaaaatctcaatatggtgacatatagtcccaccatatattttacaattccatacgatcttaacaaaccataggacaactcgtcaatattgccaagaaaattaaatagaagcaaaatgaaaaacaaagcttttcactgtttccttccccaccacccacttcaaatgggttctttctaatttatttatttcaccagtcaagtaatatagttagaattttcttttaaaatgtacattttttcatattatacgatataaattttcaataaaaagatgtcaacagataaatagtcgatgacaattacaaattcaatctttaaacatgatagattttaataatctaagagaatgagttgtgaaatatatatctaagcatacatacatatatcatattcgactccaaatcactagatattatgcagcacaacaattaattaaattcaggattttaactatatgttacctcctttttttttaatatgtttcaaaaaaaataacatttttctttttttaataacaactttccacatagcatatttaatgccacaagattaaaggacaattttatacatttgacataactttaatttatgaccacatgacaaaaactcttttttatttttttaaatttcgtgtcaagtcaaactaaaccattctttgtgaataataaagaacaataactaggtccaaaataaactttttatacataaataaatacataacctagactaaaactattaaattgtgtcgtattgaattaaatgattccatagttggatccgccacatggaggggtgaggggggaggggttgagggtgatgtaaacttacatatattattatatatatatatatatataagatagtttgatggatcttcaatttgtatcactaccacccaactctaaaacaaaagccaaaatgcaggccaaagcttgccataatattaacaatattcctccaaaactcttgccaccggctaaactgccgtccacggtggcgatgagcccgagccaattaacattgcctagccacgtggcgcgagccataacgatcaccacgtccccaactcatgaagtttacacaccagaaatcgatgacacagttactgcctattgggattaccaattccttttcgtgtcccaacgttctgaagctaccgaacccgtttcacttcgggtcgtggaaggatccataccatccgatttcccttccggtacgtattacctcaccgggccgggcctattcgcggatgatcatggttccacggtgcaccctctagacggacacggctacttaaggacatttgaaattgatggtagtacgggtcaggttaagtttatggctaggtacattgaaacggaggctcagactgaggagcgggacccggtgagtggaaagtggaggttcactcaccggggcccgttttcggtactgaaaggagggaagatggttggtaatacgaaagttatgaagaatgtggcgaatactagtgtgttacaatggggtggtaggttgttttgtttgtgggaaggtggtgatccttatgaaattgattctaaaactttgaatacacttggaaaatttgaattaattaagaactctgatcaagtattagaagataaaaaaattagtcatagtgattttttggatgttgctgctcagctattgaagcctatattatatggtacgatacgaaaggacttttattgtgctaaataatgaaaattgatctttatttaatgacgaattagctaaatatttttatttgcaggggtgtttaaaatgtctccaaagagattgttatctcattacaagattgatactcgtagaaacagacttttaatcatgtcatgcaacgcagaggatatgttgctccctaggagtaattttacattttatggtaagattgtttaattttatgaactgaaaattccatttaattaatttcttatgtttcttcctttttaatgtttaaagtatctattgcactagcattcatgtctggtgtagtgtaaattaggtcattattttaaataaagaaatcgattttataaagttcatattaaagaaacgattcattccttaaaatcatcgatgtaaaatttttcttatcagtaaattaaagcaacatcaaaaatgaaaggaaaaacaagctttttcatattattttggctttttttttttgcttgtaagcctgacatcagtaaggtgggattttattatatgttttcctttttttgaaaataaataaataaataagagtagagggtccagtgataaataaaatatttataatgtttttaaactaaaacaaggagtaaacataattaaatgatcattatcctagtatataatactccaataatccaactctactttttaaaaaattgtatattttcatcaacatcacatgtagatgtagtacaacgttaacaagaataattcttttgtttttgtctccatatattcataataattcaaattctagttaatttaattcattttattttttttttgtctagaatttgattccaatttccagctactacaaagccaagaattcgagatcccagatcatttaatgatacatgattgggcttttactgatactcactatatattgttcggcaaccgcatcaaactcgatatccccggtaactaattattcgatttctatactaaaaataaatatttcattttacttatttattcactaaaattttgcgtacgccatcgttgcaggatcaatgacagcagtatgtgggctttctccaatgatatcagcattatcagtaaatccaagcaaaccaacatctccaatttatttgctgcctagatttcgtaacaataatgtagaaagagattggagaaaacctatagaagctccttcacaaatgtgggtgttacatgttggaaatgcttttgaagaaattgatgaacaaaatggaaatctaaacatacaaattcaggcttctggttgctcttaccaatggttcaatttccaaaaaatgtttggtaagcaagcacgagtttatgtctgccgcactgtcagtatatataaactaaaacgttttatatagtagatgattaaaacttaatttgtttctttttctccatatatatttttcaggctatgattggcaaagtggtaaacttgatccttccatgatgaatgtagaagaaggagaagaaaagctattgcctcacttagttcaggtcttcttcctaatgtttagtttattataataaaatcgtaaaattattatttttaaaacaaaaaataaaataaataaaagacgattggacttaatcaatacatataatcattttatttcatgtgacacatatgatgatacatgagaaactttttatttttttaaagatgtttcagaatcgggtcgttattattattttatagtagtgtcacgtgtaatgcgaatttgtgatcatgggtatgcaggtatgtataaacttagataaaaaagggaattgcacaaaatgttcagtaaatgatctaaatcctgaatggaacaaagcagcagattttccagcgatgaatccagaattttcaggcagaaaaaacagatatatttatgcagcaacatgtacaggttcacgtcaagcgctaccccattttccttttgacgcagtcgtgaaattaaacgcggttgataaatcagtccaaaagtggtcagctggtagaagaagattcattggtgaacctgtttttattccaagaggaactaataaagaggatgatggataccttcttgtggttgaagtaagtaattataacttacatatacacatacactaataaagtttgcatagttagtgtcttttagcaccacatgtcttatttttctacgagtaaaatatcacttttagttactttgactttaaatatgttattttcgagtgatatatgattatgtaagaaaattttagaagtttacaatgtggtaaatttttatactctagtgtcacctttatttgttatagcagacaattcgtcttaattcaaagattgacaaattaaacgtcgtatttaaaagacattaattgtaatttatatataaaaaaaatagtattacttctattcttatgattttgtgtgtgaatatttaatttgcagtatgcagtgtcaacacaaaggtgttatcttgtaattttggatgcacaaaaaattggagagaagaatgaagtagttgcaagacttgaagtcccaagacatttgaattttcctcttggttttcatggcttttgggctcctaccaactctagcctagccaatctacaaaaaattgaatccaagtgtaaaaactcttggtcaatgatgaaggataacatggttaaacttggacaataataaaaaaaataataaaataaataatgtttttatatatatagatgttcattaatagcttaattatgcaaaagttttttagaaaatttaataaggttaattttttggtaaaatagttcatttgtatactagaatccagaagagttccaacaatgtcaattcttttatttcagatgtaagcatttttttagttgtataagctatgatcatataattaatttattttgttattattattttaaattctttataacaagtaattatcggttatttataattcttctgtataattttcccttaccaattactcattatatgatcaaccaaatatgtctgacattataattacattcaattaattacaccacattcaattggcaaagaaaaactatgatttcggcttatcttaggtgatatgcttcttaaataaagacatatacctttgtagctagacaaattcatattacaactccaatactatactttctctatttttctatctttttaaaaataattaattaaggatataataagtaaaaagaattattcttttttgattctttaaaatagacaaatgatcatagataaataaaagaatatataaacaaataattaaaaacagaaggagtactaaataaggttaatctcgctcgctaatcgtaataaaatattgaaatcgatgttgcctttgttgaaatcatttgacacggaatttctctgaaagaaacttttgtcatttgaatatctttgatatttatatttttttctaatctgctcctctttgaagacatattttattttaaaaaaatatttctttataagtgtaaatttcaaaattgataagtttgatagttaaatcaatattttatcttgtttttttttttaaagtatgagggaaaaatttcaagattaataattttatgattagatgactatttaaaataaattcttgaaatttactctggagatctatgacccaaagtctacttattatgaaggcgaaaataaaattgaaatgatctaacaaactcccgtacttgtacaagtttgtattatgaaatgttctatttaaatttttactaactaggctcttaactcaatcaaaagaagatttataaaggaaaaattatgttaatacacaatttattttatcataatctctaaaatttcctatcatttgtaaaaattacaacaatctctactctcttatattctcagatacatcactttacgcta

SEQ ID NO: 287 - DNA, 5463 bp, Solanum lycopersicum
attctaacattgccatatttttcatttttgcaacttactagtaatgattttccttctccaactttcttacaagagacgttgtaagaaagttaatgaataaggcaaaaaatggaaattacactcccatcattaatattagtatatggacccctttgaattttttttcctaaaaaagtactactccaatttaatttgggatctttactaaatcgttagttatttttcatatatacgattgtttgagcagttatttaagttaattcttcaataatttcctatgatatggcaatgccctcacgtaacttgagcacagagaacaaaagtaatcatgaaattgaatcccattgtagcggagccagaattcttaataaagggttcaaatctaaaaaaatagacacataaagtaatcagaggggtaggggaagaataaatagacacataaagtaatcgtggagggaggagtgttgacatatatcaaatatacctaaaaagttattttaatcatatataaataatataatttttttcaccgaaaggggttcgaatgaatcccctaactctaaggtatctctgccacaatgttgggattgcttaaacggtattagtaatgataaaataagtttataaaaatatgactagtctagtccgattcgttaatttgacatttaattgttactattataagttgttcaatcgtaacatgttcatgcctcattttcttttcatattattaattccattactaaaaacagtgtaaaaattatttttttttaatatgtataaaaactgaactcaatatttaatttaaattattttaagttatataccatccccttaattaataatttctgagtctcacgtagaccatatagcatatagttttctaacttatcacaaacattacataatgtcataatgggcattttccagattttacgcttcttataactgtcaaaaattgtcctataaataccaccaaaacattatcaaactttctaacataaacataatattaaatagtcataaaccatatgttaaataataataataattaattaataataacaatatggcttgttcaaagaatatttgggttattgttatattctttttgtgcattttggctggtcctattattgctcaagattacaatgattcacttggcaaagctattttattctttgaagggcaacgttctggaaaattaccagtttctcaaagagtcaaatggagaggagattccgcactcatcgatggcataattgaacatgtatgtatctatttaaaaaagaatgacgtatgagttatatgttttttaaaaaatttatgtaaattcaatattttgatacattaggtgaatttgattggaggctactatgatgctggtgacaatgtaaaatttggatggcccatggcttattctttaaccttgttgagttgggctgctattgaatatcaaacacaaatctcttcaacaaatcaacttgtacacctccaaaatgcaattcgttggggcacaaatttcttaattcgagcccatacttcaagtacaactctctatactcaggtcagtgtatcgtctcatttaaaattttaaattatatattttaggtttacaccatgctcatcaactcgttcccttaaggttaaacgcatgaaaattattcttttcttgtattgtgtagtaaagagatcgcttgaatctaagacatcgttcttttacaatagaatatcgaattacatgtaccatattgtctaaaagtttaaaaagtatcaaaaatgagaaccattatttatttattttgaatttgcgacatttgtatttttatattatcagtattcctccatccttaactaggaaatcttcaggaagttaagtatcggtccagagtccaaaaagctaatttgtaacatgttggtgtgcacaaattctgaaaatgaaatcatttttgataagaaacgttttaccttttaaagtaaaactttttgacgtgaattcaaattaatctgactttaaaacgagttatgtaatattaacaaatacattatatggacaggttggagatggaaatgcagatcaccaatgttgggaaagaccagaagacatggatactcctagaacactatataaaataacatcaaattctccaggatctgaggtggcagctgacgtggcagctgcttttgctgctgcttcaatagttttcaaaaatattgattccaactattctacaaagttattaaaaagatcaagatccgtaagcatataacttttagaaaaaaaaataatatttattttaaaagcttgatcgaacagattattaattaattgatatttgggcgcacagttatttgcatttgcggataagtatagaggatcttaccaagcttcttgtccattctattgttcctactcaggttataaggttgtaaataatttcaaaaattattcatttgttactattatttatttatttattgaagtataagttaattagtgtttttaattaatttattttttataggatgaattgttgtgggctgctgcttggctatataaggcaggtggaggaaacaattatttaaattatgcttcaatcaaccaaggttggagtcaagttgcctctgagtttagttgggatgacaagtttgctggagcccaaactttactagctaaggtcaatcctttatacatgaattcaaatattatatttgttattctggttgatcagtgtgcgaataaattcttatgtcgatagctacaagaattgaaacgctatgtataaggtttaggatctcttaaatcgtgcagaattaatcctacacagataatattgcaccgagttaaaagtactttggattgatttagcccaacagttgatatcatagtccaggttcaactaggatcaagagtatgaccaaggcaaatgtttgtaatatatagagtgaatctcgggaattgacacgtgagtcgtggtgatgggccacatagtgaggaggagattgttggatgtgcaaacaaaatcttacactgataagctcaaaagattgagaaactacatctcttaaaagatagagaccttttaaggaaaaaccgcgtgagcttgatccaaaactgactatattactccatgtcaagaatattttgggctcagacaattaaaacgttaaattctatatattaataatgtaaaatacatttatacaatcagatataacgaattcagtaaatctctaagataagcattaatcgataattagataaaaatgataactaacttgttaaataagtgataaatttactatttctatgagtagctcaacatagtgtgatttaaatttaacaatcacaagtacaaattactaaacatttttatgatcaggaataccttaatggaaagagcaatttggaaaaattcaagaaagatgctgattcatttatttgtggattaatgccagaaagtagctctatacaaattaagacaaccccaggtaaaacaaaaaagaagaagaaaatattcaaattttagaatctatactttcttgatatttgaattttaaaatataacataatactttcttatactatggtttataatttacaggtggacttttgtattatagagatagtagcaatttgcaatatgtgaatggtgccactatggtactttttatgtacactaaagtccttgaggcagctggaataggaggagttacatgtggatctgttaatttttccacatccaagattaaagcctttgcaaaattacaggtcaaatgcacataacaattttttacatccaacatattattataatatgtcactaaccattttccatgttacgaatcaatacttcgatatttaaaattattttttatattatctaattgtatatatatattttttatacatatcgataaatgaaacttaaactcgttaattttttcaggttgactacatacttggaaacaatccactcaaaatgtcatacatggtgggatttggcaacaaatatccaacaaaacttcaccatagagcctcatcactcccttcaatttataaccatccaactagggtggggtgcaacgatggctatagttcatggtacaattctaacaatccaaaccctaacacacatgtcggtgcgatcgtcggtgggcctaattccggggaccaatttattgattcgcgatcagattactctcattctgaacccacgacttatatgaatgcagcatttatagggtccgtggccgctttgattgatcaaaccaaagaaggagaacactatggggaaattaattcacaatttaacaaaacaggttttatgtgatagataaattagtaaagaagtgaatgtcatgcaattattgataaatatatgtacatataatgaattatcataaatgtatgaagctataaatattacataatagaaataaataaatatcaaaaatgtatcaaactcatgtgtttagatgcttatccgtccttttcacttgtcatatatgctaaaaataatatatattgtttctctcatcccccccccccttttattacacataaaatatactcaaacttagaattttgaagcataataaataaatataatttgataaaataaactccaaaaaaataatttcaattcgagagcgaatgtcaagtcagatcaattaaaaaaggaacacataaaataaaagattgtttgatttgaagataagttatactaaaattagttatttgagatcaattgttctgactttatatactcctaaatgaaaaaataaaaatatttgcttcaaaaataccttaatttttttctttcgagataattaatcttatattccaccttttaacaagataatttagctccatagaaattatatttctgtataacttatatcatgattaataatcaaataaaatataaaattgtacttgtaaaaattttattctaaaactatgcacatttatgcaacataccaaactacccctaatagtgttttatgctgacgaagtcttcgccttactgtacaaagttactcataatagttgtggcccaaattgttgaccaaatctttttttaatttgaggttaaatatttatattaaaattagattaattttaatttgtgctgcagagaaggaatttaaactcaaaatttttaattaaaaattaaataattttattcattgtattatatttatagataacgacgaaaacaaatagtagtagtaaacgacttcaacaatgaaaataacagatacgtgcatatttatcgacatccacgcgtactaggaatgatgacatctaattaattgaaaagtcttacaagtaatttctataacttataagaaccgacaagcttatataataggatgtaaaaatagagatgaaatttaaaatttcaattatttgttgtaataattttgaattaataacttgtaaatatttaaggattt

SEQ ID NO: 288 - DNA, 7295 bp, Solanum lycopersicum
  modified_base (7162)..(7295): a, c, t, g, unknown or other
gatataattttttgtaattataaattattttataaaacctgaaataaatattttaaaattaaattatgacttaatataaaatatatcattatttttgaagtaaccgagaagaaaaatataggtgaaattaacatgcaaatgatagggccaatcaacacaatgtttaagattgatcataaaagagcattcccccaaatacaatacgtggataactaagatatatcacatataaaaactagaaactgaaagcaattttgagtgatttattataaatatagaaatgacttctacacaaaattaaaaagaaaattatagaaaagagtaaattataataaattatagaaaagagtaaattatactcaattaagaagttttgtaactattgatttcatttatatttgagtacgtagaaaattatgaacaaaggaatttattataaatatagaaatgacttctatacaaaattaaaaagaaaattatagaaatagtgtaaattatactaacttatagaaaagagtaaattatactcgattaagaaattttgtaactattaatttcctttatatttgagtacgtagaaaattacgaacaaacttcttaaatatttaaaatgctttttatgaataattatatatgagtaatactattttttacaatttattaaaaaaaataatcattacacactccgagaaaaacttgttaacacaagacaaattatagcatagcgcacacaaattataattaaatccttctttttccctccgttaatctcgctcataaatctttaaaaaagcaaaatttaaaacccggtccatcaaaagtaggaaaaaaaacccggtctaacaaaacggtcaaaattaacctcatcgttttctcaaccaaatccaatagcatcccaccacgtgtcgtaacaatattggtttaaccccaggaatccaatgaactaaacaacaactttttctttatataaaatcagtcttataattctctttttactcctaacttgtgtgagctctatttttttttccctcagttcacaaccaaataatggcgccaaaatatacctccatcattttcctcttccttctcttcaactccttttcatgttcattcggagggggtcatgattatcatgacgccctccgaaaaagcatcctgttctacgaaggacaacgatccggaaaattaccgccggatcaacgtatcaaatggcgtagagactccgcattacacgacggtgcttccgccggagtaagtagtataataacaatcaaaatacatccgtaattttttgattttccaaacattttacctggatcgaattttttttttcgttacaggttgatttgacaggaggctattacgatgccggagataatgtgaaatttgtttttccgatggcgtttacgacgacattgttatcgtggagtataattgattttaaaaggaatatagggaatgaattgggtaatgcagtgaaggcggtgaaatggggaactgattttctgttgaaagctacggcgagagatggagtgatatatgtacaagttggtgatgcgttttcagatcacagttgttgggagagaccagaagatatggatacattaagaactgtttataaaattgatgcgaataatcccggttccgatgtcgccggtgaaatcgctgctgcattagctgctgcatccattgttttccgttcactggattcttcctactcaaatctactgcttgatcgcgctgttaaagtaaggaaaaaatatattttatgcttttaataattgactttgctttgtgaataaacgaataataagtaacatgtttttggtgcattggtttttcttttttttcttttacattttcgaataattatgtattaaaataatttagaaaatccaggattggtttgattcactctgtaaagtctaaaaagtaaaatgctttgggcagtgttgtgttagtgtctttttttctctgctggttgaactggcattaaataagtgttgttgactgcatttgcttattagttatacatatatatattaatattgtatataaaagaaattattttttctaatatagcctacgaaacgatccgttaagttactgtctagtatggacatataaagtttgttttgcatgtgaacaaggacttgttgggtggggtggggtgggtgggtgggattattaactctaaacaaaatcttgctattagaatcatgaagattgatttacacatgcatcttaatctatatatgtgaacatttaaatttgatgaacatatttatgtatagtcacaaaaataggtttgtctaaccaattatgtaaagttctaaaatgtcactgtcatctagcagaaaaaagctaaaaataaaaaaaaagaatatgaccgttgtaataaaatcagtcttttggttgcttttgtaggttttcgattttgccaatagacatagaggtgcatacagctccagcctacactctgctgtttgccctttctattgtgactttaatggttatcaggtaaactcttgtataatatataaacgtgtccttaatctagtcttaacttatatttatattctcctacatatgtattctttaattttgtatatgtataaatagacacttaaagttgaataagtagatacacaagtcttgcgtgacatgatatatgtatgagacatgcgcatatctcgcataatagataaatatgtccttaatatgatcttagcttgtatctacaccctcctatatatgtatccttaaattttgtatatgtaatagtagtcacttaaagttgaataagtagaacacaggtcccgcatgacatgatatatgtaggagctatgtgtttatctagcataacacattactgtgttcttaaactggtatatccttcaatactgcgcacacgaaagttgacacttaaatgtgtgtaaagtagaataagtagaaacacacacacatatagggcacatttgtttattttgcataatacataaacgtgttcttaaattggtgttagctgatatctatatcctttaattttacgcccacataagtcgacacttaaatatgtataaaattaagaaagtaagcacacaacttacatgacgtaatatatatatgacgcacgtgtctacttattccgagtcaaaattagtaatgtttgacataaaatttgggtgagaatgtacaggatgaattgctttggggtgcagcatggttacataaagcaacaagaagaaggcaatatagagagtacatagtgaaaaatgaagtaattttaagagcaggagatacaattaatgaatttggttgggacaacaaacatgctggtattaatgtccttatttccaaggttagtaatttaattaattaatttatctatggataaggagacattattagtacttaattaattgtattactttttttttctcattacataataatctgtccttgtctcatttacaacttagatatattcttgtgatatctattcttgacttgttcagtctgccaatcacatgctgtagatagatagatatagttatccatatcagaatgtccatttagtgggcccactcttaatttgaaaattaacgtaaaactgcttcatcttaaaatattaatcaaatgattcactgaataaatatcgaaaggaaaaagagtaggttcaatcataacaagtaactaagcacattgatattttttccctcttaaaacaaatttcaaaactctaatcatcattaattttgtgtatgtgtgtaattattccacatgacagagttttggttattatgggctccatgtgtgtttggtgttcaaacttaacttatttgcatcaacatacacatacataaaattaaaattataaaatgaaaaaaagaaggtgaaagctgtatatagaagtgctccatgtgaagtgtgtggacaaaaaatgatacaaaattaaaatgagacaaaaaaaaagtgaggttggtaatagtccttcatgaagtaataaagagcaagagaagtgactttactagtggtaagcatgtgcaaaaagacagttgcttatctatatatatatatacatactttcatacggagaaagttagagttatgatacaagtggacctctcgattgaagtgttgattatgaattatcaattatcgttcaggtttaatagtggagtcagaatttttttacaaaaaagttctatattatataagaaataatttgaatcatgtataaatagtataagttggctctgacctgtcttcgtcgcaagtttatgtaatgtaatttaacttgaaacaaattttaagaaagaaagactaatttctgaaactatcaagactacggagtaatattttgactaagttcatttcattaattaaattattactaaatatagtaaagtatacgacagaaaaaataaatgagtcgtatatattaaaacattgcgagtaatattttatgtaagtcccccaaccctcaatcttatattgttcggactcttcaaagatattaatggatgtgtgtcgaatttttcaagagtaatatatattttgaaaaatctgacaaaataaaacatcgaaactgaagactctgacaagttacatttgtgcttagattctccttatctcatggaattatactaatctcaactagttggaatataaagttttaatatttcaaataatttttttattttatttttgacaggaagtgttaatgggaaaagcaccagatctaaaatcatttcaagtaaatgcagatgcattcatttgttcaatattacctggaatttctcatccccaagtccaatattctccaggtaaattgggaatagttaattaattaataataaaccatttattaaattaaattactaatgtttttttgtttgtcattttattgttgtttgtgtgtgaaggtggactcattgtcaaacctggggtttgtaacatgcagcatgtgacatctttgtccttcttactcttaacttattctaattatcttagtcatgccaatcatgttgtgccatgtggttccatgacagccacccctgccctcctcaaacacattgccaaacgtcaggtactactctcttcgtcttaatttatctgatacagtttaactatatacaaagtttaagtaatgtaaaaaacaacttttacagaggaaaatatttttcagtttttccatgtttgatcggtcaaaacgttaaagaaatgaggaaaacaagttacacaagtgatattctggatatattgtcttctctctactcactcgatccctcaacctaagtcattctcgaacccccactccccatctcatctcgtttacttactctatagaaattagaacgcaagtaaagaaatctactttttgcgtgtgtgtgtttagtatagaggaaaatgtttttcaattttttcatatttgatcggtcaaaacgttaaagaaatgaggaaattttttgacttttctagaaagaaaaaaaagtaggaaaaacaagttacacaagtgatattctggatatattgtcttctccacactcactcgatccctcaacctttattcatcctcgaacccccactccccatctcatctcgtttacttagaacacaagtaaagaaatctacttattttttcatgaaaacataatgatttttttttgaaacagactaaagagtggttatgaattgttgtaggtggattatattctgggagataatcctcaaagaatgtcatatatggtagggtatggtccacattacccacaaaggattcaccataggggtagctctgtgccatctgtggccacacattcagcacgtattggttgcaaagagggatctcgatactttttttcaccaaacccaaacccaaatcgattaattggtgctgttgttggagggccaaatttaacagactcgttcccagacgccagaccctattttcaagaatctgagcccacaacatatgttaatgcaccattagtgggcctattggcttactttgcagcccattctaattgatataaacatgtgtaaagagagaatgtagtggtgtgcaaaggccaccctctctattattgtgttgttgttgtctaataggactaatgttgttgttttttaatcccactatatatatatatattatattaatacaaaaaaagaatatcttatcccatcttttgtctaagaaaaagaaagatatctaatgaacaagggatttgtacttttgaaattgtagtggaagttgtttttatcttattatacatgaaaattgttttgaatacttacagaaaaaaaaaattgattctacaaagttaggtgtttctaatgttattgtgtgttttgtttagcaaaacgagaattttttttctttacatatgtaacaaaatctgaaaatccaactatatatattgatgagagaattgaaacattattacataactttagaatcgtaattagaatatctaaacaattgaattataatgaaagtggaaataacaagtagccaagaaagaggatgaaaaacttaggctctagaagaacatacatttttcttcaatatgcataattactatattagtgatcactattccttttgaaggaacagtttttccactcactactcgatccaaatcccaaattagtttgaacctattacttgttctcggacacaatagcttgtttcagcctaataactatttgtgtgaccttagtatttatattggattgaacttgattcataacaacacacttttactcttcaaatgaagaaaatatacgacttagaaaaactataatagaaaattttctcaaattttctaccttttgagatcagtccatataagcacactacgacaaaatcaatatttaacagtaataaataaacatattaataaataatattaaaatttttattggtattagttgagtgtcattagatctactgtcattaaaggctttaggaacatatacaaaaaaaggcaactttcatatatagcaaacaaaaaattcatatttgtatgctataacaaactttgcataattgcgctccatagtagacataaaactgtataatttgctatacatatacaattatataattcgctggcctagattgtataattcgcttgcctatttcgctgcaattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 289 - DNA, 4241 bp, Solanum lycopersicum
tcttcttttttttttcattgggagtgttttttttttttaaaaaaacttgtttttcttttcttttttcaaagaggtatatttcgtgtttataatattgggagtaccaaaatgctactactagtatatgaaatgctccgttcatttttatttgtttatttttttttaataatttttcataattatttatttattttgacataaaaaatgatattttttatctattatatcgttaattaatgactaatgactaattactttgaaaaatataaatttttcattcacctcataattaatagggataaaataataaactcagtatatcattaattattttcttaatagatatgtcaattcaaaagtgaataagtgaaaaagagagaataattatcatagaatgtggtatagtgaatacaatattcaaaatcaggttatggcaaaattcataatcggaagtacttttccataatgaggccatacaatgagaaaatattcaaattagggaaaacacataaattaccttctaaaattattctcgaaaaatcggttatacgttcaaacttttgtgacgatttattacacatctaatcttgttcaaaatgatattaatatccactcaaacacgcaatcaatagctattattgataagagatagtaaatgttttataaaattagttaaagcgcgcaaagacgagttcaaatacacaatcataaaaaagataagagtgtgtgcctctcaataaaataagtagtactaaaaatgaaaacaagaaacaagaaagaatgttggttctttagtggtgactctcaatgaagtacctactttcaacttactctctctatactctctactactgctactcagtactgattcctttcacacacactgtgccctgtaaaccctgtccagggaccccccatttcccctttcccctttctccttccttcattaccttacctccaacacaaacactaatcttttttacacctctaacttacctccatggcagaatcacttgttgaaccttgtacaacctcttatccccttaaagtttcaatctttatcctattcttcttgattttccctttcttgaacccattttcatctgcatttcctctttctcatgatactaatgcaactggggtgttcaatcttgaaacagaagaggacatgggtttgcttttgttcttcaagttacagtttcaagaaacccctttatcaagctgggatgttagtgttcctctgtcaaactggactggtgttacccggtctaaccagacagggcgggtcactggacttaacctcacaaggtttaacttgtcaggacaggttcatccttgtttgtgtaatcttacttttcttgaaacccttgtgttgtctcataatagctttaacaattcaataccttcttgtttatggaagttgtggagtcttaagaccttagatcttagctataatatttttactcttcttgttcctagtacatttgcagcaactatgagtaagttaattgagcttgaccttagtcataacatgttgagtggtgaaatcccaatgtggatagggaatgtctcaatgtcacttgaaaaactcaacttggggtttaatagttttcatggggatatacctaagagcttgttgaatttgatgtctttgaagtatcttgatttgtctcataatagtttgatgggaaatgtgggtgattttaaccaagaattggtcacacttaatcttgagtctaatttgttatcgggtactttgccttgtttatattcgtcaagagaatcacttacacttcttaatttagcaaacaattcgattcttggaggtataccaacgtgtctctcgagtcttgggggtttgacacagctcaacttgtcacacaatgaattacgatatggtatctcgcctagactggttttttcagagaggttatgtttgttggacttgagttataatgagctatcagggaagattccaagtaggattgtcgaggcatcggacaagtctggactactacttcttgacctgtctcacaatcagttctctggtaatattcctgtaacgataacagaattgaagagcttgcaagcgttgtttctgtcttataatcttcttgtgggcgaaataccagaaaggattggtaatttgacctatctacaggtgattgatctctcacataacttcctcactggctcgattcctttgaacattgtaggatgtttccaactactggcgctgatactaaacagtaataatctttctggggaaattcagccagtgcttgacgcgttggatagtctaaagatatttgatataggaaacaacaagatttctggtgagatcccactgacattggcaggctgcaagtcgttggaagttgttgacttaagctctaacaatctctcaggatctctaaatgatgcaataaccaaatggtcaaacctcaaattcctctcccttgctaggaacaagttcagtggatctctgccaagttggttgtttacatttcaggctattcatactctagatttttctggaaacaaattctcaggatatataccagatggtaactttaacactagtccaaatttctacaacggcgacattaggaaaaccatttctgcagtaccatcaatttcagctcgaagcctggatatcaaactttcactcgttgctgatgaaactagtttgagcttcaagtataacctcacaaccacaattggaattgatctgtctgacaatttgcttcatggtgaaattccagaaggtctgttcggattacatggtctggagtaccttaacttgtcatacaattttcttaatggtccagttccagggagtttagggaagttgcagaagctaaaggcacttgatttgtcacacaattctttatctggccacatccctgaaaacattacttccctcagaaatttgacagttttaaatctttcatataattgtttctctggtgttatttcgacaaaacgaggttattggaaatttcctggagcatttgctggcaatccagacttgtgtatggaatcatctggtaatgtctgtcaaagaactttgcctgtaaagccagggaagaaatttgaagaggaaatggaagagggaccattatcagtttggattttctgtataagtgctttagttagcttctatgttggcgttgtcgttttattttgttcatctcgaacaagaagctgtattctgcaaacaaaaaatttagcaggttgaaagtgataagtgatcacattgtacagcaacttatgaattgtatcatatagcaaaacagcttcaagcatatcttgtttactaaccagcccttttttaaaaaaaaaaactagttagcaatgcttcatgtagattttagttagttgaaaatgtgatatttcaatatgcctcagaacagttgaatgttgattttttgctgtgtgatactttcaatggaatagtttttctatggctttgtctatttgagctaccttaacaccatgaagaacatgcagggtctataaccaccaaaagtttttttagtataaccattttacatccagaatgcatagaatgattaattcagattcatattgtgtaaagcctattaaaggggaacccgctccttaccaagtcatcgatcttcaagattcatattcctacattgcctcaaatataataaacaaacatagtgaccatttttgagttagattccaagcatgtgaattatctcattatcaaattgtttggtcttcaagaataaacttataatctttttgtagtgccatggaatttattcctttcaagtgttacagaaagtatttgtcctaatccatggaataatttggtggtagtagtgattaaataatcaaaattctataatgtatgtgaaaaagtagaaagaatagattcctcactatcatgttatacaatatggcagtagtgatcaaagttgcaccatcatgttatacaacatggcagtagtggtcaaagttgctataatgtatattgcaatgctgaaataacatgacaaaaaacatttctacgattcctttcttaacgttcattttcacatttacatgtccttttaaggaattaggcgtattcctcaattttttgtgtgtattaaccaatggatctgacaccgaagcacccaaaacaatttttccaaaaactttatgaggacctacataatgatgacttggagaaccattaagtacactcaccaccaattttttaacgt

SEQ ID NO: 290 - DNA, 7160 bp, Solanum lycopersicum
ggctacgctactgcccgctacgaagcgcttccccctctcttacaccctaaatagaccatatgctacttgaatttatcataatcgaactctaataaagatctcatttagttggcgagagtttgatttctgaggaactctcttctcatctcacctaccctcttactgaaaattaaccataagaggagcatacaagagcatgtgaaaatatgagtaaagttaggggtggtgggggtgcctacattacaagtgactttaaatagcaacacagatgaatgaatgagaatctaatacctccattcatgaaaaaggcccacacaccctttagaaaaataccaaatccaaattagtcaccactctatactctatcccttctcttacccatgcttcatgtccccttccaacttcccatttttctcttacacaatcccaacttggtcggaaaaactaaattaaaataatattataaaattgtccaaacactatatattataatgggggtaacaaaatttgttgtctagaatcagattctaccaaaaaaggttaagtgaatcaaactttgcccccttttacctgtataaaagctggcaaaactttgatatatcattaggcaaaagtgtatatatgttaacaaacatagacctttattaaaccgtcgattttctctaacaaataaagaatatttttggttcgataaacttaaatagtgttatttttgaaagatggtaaaatattttagtgcactttaatagtgtcatttcatttcttgatgtcacattgtgtaataaaaaacatgagctactcaaatcacattcaatttgcaatgattcaagaaaatcaaacatttaattttttgactttattatacctaagaaagctaatgttgaatttaacaagaattttccaccctgtcatcaaagagagagagagaggggattagagaaggcactagagatagaggcttggtggaattttgtttccttcttaggataagaaagaaagaaagatataaaaataaaatcttgaaaaaacataaagttgtggatgcaaatctcccataagttctcatgttaccccaccaccataaccaatcaccctcaatctcactttctcctccctctttctctggagaggtttgtttttttgggtggacaatgcctatagtaacttcacaagaatagcatctcatcattcatcaaagaataacatttggggtttgttaaagttaggttctttactagaatttgcctaaaaaaaatcatctttgtaatctttatctcctcagtgaaagctacagggaacagtcaaagtatagataagattaaccccaatatacttctgtctaagaaagactcaataacatggtgtttacatagtaagagagaaaaatagagagaaaaagactagtctttggtgttgttgaaggaagatgtcaggtggtggttgtagcatagtatggtttagaagggatctgagagtggaagataaccctgctttggctgctggagttagagcaggggcagttattgctgtgtttatttatgctcctgaagaagaagggcattattatcctggtagagtttcaagatggtggcttaagcagagtttggctcatcttgattcatctttgaagagtcttggaacctcccttattacaaagagatctactgatagtatttcttctcttcttgaagttgttaaatctactggtgctactcagctcttcttcaatcatttgtatggttagtacttgtttccatttttttctgtggttttcttgcttctttaaataaaagatagagcaccactgttttacttcctttttttggctttcctttgtaatcattttgtttgatttgattattcttaatgttgtttcaaaagttattagtactatattgttgggatggcttaattgggattggtgcttcctatatgtccttttaagaataagatattgagttgtcttctggtaaacataataaattattagcatgtgtcttcctcatataactaaagaattttaagtgcaatactttttgctatgctcaatcctcagtgcttgtagcattctctggctactaatttgtttagtgcctgaattagaactacagtaatctggatttgttgtactaaacatattccatatccttattatttgattaatagaagcagaaagggtgttgcttgacatttgatctgatcatggttgaatggataattgctaatagatatgcatggcttttattttaagcatctctttacagtacaaggatttataagatgcatagttttgctcagccaatttcatccactaccttatcctgaccaacacctttgacttctttggctttagatcctatttcacttgtgagagatcatcgcacaaaagaaatcttaacagctcaaggtatatcagtgcgttcctttaatgctgatttgctctatgaaccatgggaagttaatgacgatgaaggtcgcccgttcacaacattttctgctttttgggagaaatgccttagcatgccttatgatccagaagctccacttcttcctcccaaaaggattatatctggtttgttctcatctgagcttctccatatcttgttggctttctggataaatttctattattttttgtacatatttttgtaacataaggtgcttagggtagaaggttagtagggcatgaagggtctttcagaaacaacctctctacctccacaatgtaggggtaatatccgcgtatattctaccgccgcttgtaggattatactgggtatgttgttgtcgtgcttggcttagtgttacgttccaccaatgatgcacacaaattaggagatctccctccaggtaatagatatattaattgtcagataaaaataatgtcattgcaccgtaatgaacgtgttgctacactttaagctcggagatcactacatggtgtataatgtgaatgttgcaggtattcaagtccttcaaaagtggaaaggtgataatgaacatttagatgtttgagctgtcactaacaagctaagggctaaaacaaattcctaggatggtgttaatgtacttataggagcactggtttagattttaatttagtttttacatggattcatgtgcaaactttcaggtgatgcatcaagatgcccttcagacaacttggtatttgaagatgaatcagagaaaggaagcaatgcacttcttgctcgggcatggtcacctggctggagtaatgctgataaagcactaactactttcgttaatggaccattacttgagtactcgcagaaccgtcggaaagctgatagtgcaacaacatcctttctatctccacatttacattttggggaagtcagtgttcgtaaggtattccattttgttcgcatcaagcaagttctctgggccaatgaaggaaataaagctggtgaagagagtgttaatttgttccttaagtccattgggctgagggagtactcaagatacatgagttttaatcatccttatagccatgaaaggccccttcttggtcacctaaggtacttcccatgggtagtggatgaaggctactttaaggcatggagacaaggtagaacaggttatcctttggttgatgctggtatgagagagttatgggcaactggttggcttcatgatcgtatccgagtcgtggtatctagtttctttgtgaaggttctgcagcttccatggaggtgggggatgaagtatttttgggacacattgttagatgcagatcttgagagtgatgctcttggttggcaatatatctctggtaccctacctgatggtcgtgagcttgatcggattgataatccacaggtatgttagggtaatctttgatgagaatctcttctttcaattggaatttttcataacttcatagttgaaattccttttcttctatttctctaacatagtagagttgctggaacaccaattatagactactaccgtaattttttttaataactttacgactattctacacttcgaatggttatagccttccatgttgcggtaagtgttattttcagattgtaagttagtttccaggcactgacttgctagtagacattgcatgaacatctcatgggcctcaatcttcttacagaaagtgctaaagcttaagatggaatgtgtgtgtgaatgcctaattgcaaattctgcttcttttatatcctgagatattacttattagtacagtgactgtgagcttcttttggtattaaattgatatgcgagtcttttcaatacaagaaacccttccttctgtttctcttgttttttcatgtaaaacaaaagtgaggctgcagattttgctatatatatccctttttccgtttctgttcttgtttcttcatgtgaattttcttggtaaaggctgaatagttatttgaacctgttctctttctggcagtttgtgggatacaagtgtgaccctcatggggaatatgtccggcggtggcttcctgaacttgctaggctgcccaccgaatggatacaccatccatggaatgcaccagaatctgtgcttgaagctgctggcattgagctgggttccaattatcctcttcctatagttgaaattgattcagcaaaagttagactagaacaagccctatcacaaatgtggcagaatgatgcagctgcaagagctgcgattgagaatggtatggaagaaggacatggtgactctgctgactccccaatagcatttcctcaggccatgcatatggaaatggaccatgaaccagtcaggaacaaccctgtaatagttactgttcgacgctatgaagatcaaatggtgccaagcatgacgtcatctttgttcagagctgaagatgaagagaactccgtggacattaggaattcagttgtggaaagtagggcagaagttccaacagacatcaatgtagctgaagttcataggagagacacgcgtgaccaagccgtcatgcaaactgctcgaaccaatgctaccccacattttaattttgcggtaggtaggaggaattctgaagattcaacagcagaatcttccagtagtactagagaaagggatgggggtgtagtgcctacatggtctccctcaagtagtaactattcggaccaatatgttggtgatgataatggtattgggaccagttcatcttacttgcaaaggcatccacaatctcaccagctaatgaactggcagcggctttctcaaacagggtaagctacgtgagtttcttgaataatcagtagaagaagacattcatccaaaagagatgaaaactaggaaatggacaaatttgaacattccagtttgaatataagcattagtgttgcatctagcacaaacaaacatgactactcatgaatggcactagtcacagattcacggataacatttctcatgtccttcatatttcctgtatgtcatggttagctggtgaaaaagcattgcaaattgcataaaattttaggccagtgagaagtcctacatgaaaagtctgatttaaacaaacgcaagcaaatatgaattgtgcttcctttaaactaactgcagacacatctgtatacaaatatggtgcatatttccatttttaaggccttaggctcaagacgaccaccttgaaatttccaggaaatgtcttatcctttggcttgtttaacttgcttacaggtgatcatttatgtggagttacgatagcaacaaggcggagaagcaagtggctaatacagacatttggctcagcacatttagtacagcattcatctactctttctctcatagtcctgacctgatcagccatctttgtgtctatatctctaattgatcaggtggttcgtctggattttcatcctcatctgtcgggcatccccatttacctattataccatatatgtgtctctgctgtatagtatagaagtttttcataaggccaaataagtgttagaaagaggttgcagtcctctgtcaagctcacacttgtgccttttgtttttccttctcttttctgctacttacattttgatggcaataacgattatctgaagtcctggaactaattagatttttgtggatatcatagtttcaaactctgtttgacggatgtacatgtggtttaagcagcttcatctcatatttttgttatgggaacattgtcattattctataagatttctagtttgaacattttcattgttctgcttggcagttgtgtctgttcagctgaaagctgtaagttgagttgttaacattccctgtttggtcttgtgtgtgcgtgtttgtgtgtgtatcttatcaatgcatcagaagatattcgggtactcgaacgagcagttcttatagtaagttgtgttacactagaacaagagagactcttctatgttttggacagaaatccaacatcatttgcaacttcagctagtccttattgttgttgaacatgcattagtaaagtgtttagccagaaacaccaaaaaaagaaaaaaaaaacatttcagttgagtggaaatgatgagtttacatgaaaaatataagtaatctgaaatttgaagcacgactctctatcatcacaagcaatatctaagatgacagatactaactgaaagctttcaaaatcagaagttggaatatgatttgtttcagttgaacatataaacggaaccatggtgaagtgttcatactagactcttttggttcaagtttttaatacacttaaagcacatcttatcaagtatatatatgttagatagaatatgtcatatttttaaattatacatatcaattttaactgaaacatatctattagcttaactacctaatagatacttgataagataggtacaagtttattaagagtttgaatgaaagtatttaatagaaacaaattataatttaaatgagtatcctgtacgatcgttgaaatattaattaataaaagaactctgataaaaacaagtagtacatggacggttaatgatcataaacttttcgtaaagttttagcatatcacttaagtggatttctaagataaggtaattaataccccagtgttttttttctttgaatgtttcaatagtcaaagcttaaatctaaatgatgccctttaataattcatagatgggatatgatgaagaaaagttataag

SEQ ID NO: 291 - DNA, 3514 bp, Solanum lycopersicum
aatcttttttctaataaaaagaataattttattcttagaactcaaattcaaaatatataattaataatagaagaatgcttatcaattaccaccaactcactgttactattggtagtaggataaaaaggacatgacacaaattgtcaaggttagatttttttttccttcttcgactaattatgattcatatcgaaaagttcaatttagagctaaagcatgtttttatactaacaaaatcttttatttttcataaaacgttatacttaccataacaccataatcactaatggtattatggttaagttttaaaatgcgtcatagtttaaagcaaaaatgtgtatatatataccttgctataagtggtgtcgtaagacactactttctctctctatatatatacatatattataaccaaatataaatattgaatatcaatataaaaagaatgataccaatagttattatagtgatacctatgtacttaaaattattgcaatgaataaagtattcacttctttttataatacatctaaactcgatagtagaattcatatagaaatattcaatcaaataattaaaaaaattaaaattcatatatatatatatatataatacaatgaatgtaccttttctacgttaatttaggttatataaaatatagaactgaaaaaaattgggcaatcctttgacatattaacattttgatctttctattcagtctcatttagtattttttttcttcaaaattttcatgaaataatttcatacgagttacagataatgaggtcggtccatgaattttccttccctttttttttgtctacttatcttgctctactccatttatatttttcttaaacaaaatattattcattgtttagaggagggggtgggaggggggggggaggggctttacacaaagattccaaaaggttttttaaagctcttatatatactcttttgacaccctcattgtaattgccatctaagtatcaatccaaacaaaaaataacacttaatacaaattccatcaaatctcttccatatatttccattaatttgattttcctctcttagcttgcaactttgtccactttgggatattgtggtttttgcataaggtaacatttaatttcatttcttgaaaatttaccaaggaattagtaaacataatttataataaaaagttgatttttttttttgtaagtttattgtatttgtggctgatttttcttcttcttattttgtagagggaaaaccaatattttgcatttgatattcatcaagatgtcaacacattgtgtaagcattatcaagaatttcaacttgtcttcaaagatgaaagaagaagattatgatcatgagcaagtgatcaaagatcaaccaattaaaatatttgattggagttcaattttatcttcttcaaagaatgaagagtcatcttcaactagtctttatgttcatcctctggacaaaagctcgagaaattcgttgagtgaaaaaagtcttgaaatttgtactgagagccttggatcagagactggatctggctctgattgttttctctcttcacctacatctgagcacgaagattcgaatgatgacaaacacgatcatcatcattattaccatcaacaacaatattctgttgtctcagagtcctttgaggattttcatgtttataatcatagcaagagattgatatcttcttcaaagtcttttcctccttctcttccttctattcacatgcaatcacatagacaaaatggtagattgattcttgaagcggcttccatttcacctaacaatagtctccatgctcaacgccttgacggtcaccttcttctcaccgtcatcaatcaaaataattatgaacatgaaatagagaaacgcgaggatgaagttgaagagtttgagaaagtgttcgatgatattcaagaagttgaaggtaaagaaataccccactcagacagtggtggtggtgatgaagaagagtttgagaaagtgttcgatgatatccatgtttccttttgagatgtttctatgacaggtaatcttagatacgcgtttcgatagtaattaattgaagttcagaaaaaaatattattatctagtttcaataaaataaaaaaatctttaaaatacatacaataatcaaatgatttctaatttcatgttcaattctttatttaatcttcaacaactaattgttgtttaaataaatttttatttactttgatgtttgtaattagacatatttcaaaaattatatgccaaatttgataatgtcacaagtatttatacttgttccagccaataattattggaaccatatgctctttatacaaaaaaaaagaaaagaaaaagaaaaagaaattctatatatggtcatatttgtttcattatgattctttgttaatggaaaaaaatatatatcattttcatatacttgatcacacttacaatatgtattgtattcacatatattaaatgatgatgattgaaggtttctttttttttctttttcaaaagtaaatagagataacgaaattcgccaaaagaaaaaaatatatcttgagaacttcaattacaagtcggtgatattatgatttttacgagaaaaaaaatattatatttatatattcttaagataatttaattttaaaaattttaatttattttttaatcagatgatttataattgcaactatatctaagacgtcttttttataacgctcattatttttggaaaaaaaattatatctaatcaaataaatcttacaaatttagacaaaaatagatatattttacaaaagtcatttaatattcaatatacttgcttcaaattaataatccctttattgtcaaataaatccaataagcatttacacttgaattaagagatacaaactattattataaatgaaagttgaaaaatgacattgcaaagttaaaattatgtttaaacatgtattctattttttaaaaagatcaaaatggtaattggtaaaagaaaattagtaaaaaaagaattatctcaaaactaaccaaaagattaattaatatacaagtaaatagggacagaagaattttttttttgtcttagtctctattacgttgtatctcattatatcacattctattaatataatttaaaaacaaatcaccatgttgattctgtcgagaggtcatactgaccacaaatagatagattaatgacgagttcttgccagactaagagctttatcaaataaatcgcttttcacgacatttttttttcatttctatagaaacatataaattacagtctaataagttttgaattttgtaatgattgtggattaagactactaaacaggttgaagtaaaaagtcctgaagtaagcatcgtcaaaaagcatagaaagatgaaatgtcgatgatatataaatatcgaatgaataatattatttttattatgctattaatacttgctctcgaaaaaattaaaaaaaaaaataagggggaattaattg

SEQ ID NO: 292 - DNA, 5624 bp, Solanum lycopersicum
tttttaaaatgtttgatttgatataaattttaaaaagtaaataatttttttaaaaatttatagtctaaaacaaatcttagatttttatgtaagtaaaacaaaattttataattaaattatttctaattatagaagaatggcaatcattttaggacaaattaaaaaataaaaagtgtcaaataaattaagacgataaaaatattatccaatattttagtaatataatctcattttatccaataatattattatttgaaatcaagtaaaaatttcttttatacattatttataataataaaaatgacagttttgatgcactataactttagttatgtgtgagagtatgtgatttaggaaacttttttaacacaagaatttatagtacgcaatctaatttagtttgcatttcaatggatatattattttgatcatttgaatttgtaacttgctaattatataataataataattttatgaattacgtaaagactttcaaaaagacatgttcacaaattttggaagtttggtttcccatatagataattttagacaaagaaaaaggaagaccattcacatatagacacataaaaccaaacttcaaatcatactttgaggagaaaaaaaaacacatattacagagagaagagctgaaaatatgggtcacatggcatgtggtgcaccagctgtgtccactcttctatctctcctcttccaatatccacgccaccccacaccccccttcatacccccacctccacccccacccccatataccccagagattagagtgtgttctcaaaatttcaactatacatacccttcttaccttcctaactctgccttttgactctcttcacattctactattcttctccctttccctatttgtctgttaaaaacttatcttattcttttgagaaaaatatggaaccccatcaagaactcaagctatagattcaagaaaatcaccatttaagctataaagtttcaatctttgaagatgaaagctcacaaaactgtgtttaaccaacatcctttgagcttaaacaagcttttctttgttcttcttcttatcttttttcttccaccagcttcaccagcagcttctgttaatggtctttataaagactcccaacagcttctttcctttaaagctgcactcccaccaaccccaactctgcttcagaactggttgtcatctactggcccttgtagtttcactggtgtttcatgcaagaattctagagtttcttctatagatctcagtaacacttttttaagtgtggatttcagtttggtcacttcttatttgcttcccctttctaatttggagtctttagtgttaaagaatgctaatcttagtggttctttaacttctgctgcaaaatcccaatgtggggttactttagactccatagatctagctgaaaacacaatttcaggacctatttctgatatctctagctttggtgtttgttcaaaccttaagtctcttaatctttctaagaatttcttggaccctcctggtaaagaaatgcttaaagctgcaacctttagcctccaagttcttgatctttcttacaataatatctcagggtttaacttgtttccatgggtttcatctatggggtttgttgaacttgagttcttttctctcaagggtaacaagctagctggaagtattcctgaattagacttcaagaatttgtcatatttggatctttctgcaaataatttctcaactgtttttccttcattcaaagattgctccaatttgcagcacttggatttgtcatccaacaagttttatggtgatattggttcttcactttcttcatgtgggaagctcagttttctcaaccttaccaataaccagtttgtaggtttggtccctaagttaccaagtgaaagtctacagtatttgtacttaagagggaatgattttcagggtgtgtacccaaaccaacttgctgatttgtgcaaaactgtggtggaattggacttgtcatacaataatttctcaggcatggttcctgagagccttggtgaatgttcaagtttggaacttgttgatatttcctacaataatttctctggtaagttgcctgttgatactctctccaagttgagtaatattaagactatggtcttatcattcaacaaatttgttggtggtttgcctgattctttctctaatttactgaaattggagactttggatatgagttctaataatctcacaggggttattccatctgggatttgcaaagatcctatgaataacttgaaagtgctgtaccttcagaataacttgtttaaaggccctatacctgacagtctaagcaactgttcacagctggtgtcacttgatcttagctttaattacttgactgggagtataccatctagtttggggtcattgtcaaagctaaaggatctcatcctttggttaaatcagctttcaggggaaatcccacaggagttgatgtacttgcaggctttggagaatttgattcttgattttaatgacttaactggaccaatacctgcaagtcttagcaactgtaccaagttgaattggatttcattgtcaaataaccaattgagtggtgagataccggcttctcttgggcgtttgtcaaatctagctattcttaagcttggaaacaactcaatctcagggaatatacctgctgaattgggtaattgccagagcttgatatggttggatctcaatactaatttcctgaatggatccattccgccgcctttgttcaagcaatctggcaatattgcagtggcattactgaccgggaagcgatacgtgtatatcaagaatgatgggagtaaggagtgccatggagcagggaatctgctggagtttggagggattagacaggaacagctggatagaatctcaacaaggcatccttgcaatttcacaagagtttatagaggtatcactcagccaacatttaaccacaatggctctatgatatttcttgatttatcttataataagttggaaggtagtatcccaaaggaattaggggcaatgtactatctgtctatattgaatttggggcataatgatctgtctggtatgattcctcaacaacttggaggcttgaagaatgttgcaattcttgatttgtcatataataggttcaatggcacgatcccgaattccctcaccagtcttacattgcttggagagattgacctgtcaaacaataatctcagtggaatgattcctgaatctgcaccatttgacacattccctgattataggtttgcgaataattccctctgtgggtatcctctccccataccttgtagctcggggccgaaatcggatgcaaatcagcatcagaagtctcaccgcagacaagcatcgttggcagggagtgtggccatgggtttgttattttccctcttttgtatctttggtttgattattgttgccatagagacgaagaagaggaggaggaagaaggaggctgctcttgaagcttatatggatggtcattcacattctgcaactgccaacagtgcctggaagtttacgagtgctcgtgaggcgttaagcatcaaccttgcagcatttgagaagcctctcaggaagctcacatttgctgatcttctcgaagccaccaatggtttccacaacgacagtcttgtgggctctggtggttttggtgatgtctacaaagctcagttgaaggatgggagtgttgtagctattaagaaattgatacacgtcagtggacagggtgatcgagaattcactgctgaaatggaaaccatagggaagatcaagcaccgcaaccttgtccctcttttgggctactgcaaagtaggggaagaaagactactggtttatgaatacatgaagtatggaagtcttgaagatgtcctgcatgatcggaagaaaattgggatcaagctgaattggcctgcaagaaggaaaattgccattggagctgcgagaggtttggctttcctacaccataactgcattccacacatcattcaccgggacatgaaatcaagtaatgtcttgcttgatgaaaatttggaagccagagtatctgatttcggaatggcaaggttaatgagtgctatggacactcatttgagtgtcagcactcttgccggcactccaggatacgtacctcctgaatattaccaaagctttagatgttctacaaaaggagacgtttatagttatggtgtcgtattacttgagcttctaaccggcaaacagccaacagattcagctgattttggtgacaacaatcttgtcggatgggtaaagctgcacgctaagggaaaaataacagatgtctttgaccgggagctattgaaagaggatgcaagcattgagattgaacttctacaacacttaaaggtagcttgtgcttgcttagatgatcgacattggaaacgtcccacaatgatacaagttatggctatgtttaaggagattcaagcagggtcaggcatggattcgacatcgacaatcggagctgatgatgttaattttagtggagttgaaggagggatagaaatggggataaatggaagtataaaagaaggcaatgagctgagcaaacacctttgaatgcactaaatgaagagtttattgaaagctcacaaattttccaaaatcatcatatgcaaagtgtaatttttagcccccaattattgtatgtaccactagttcccatccataaaatcttgtgttattatacataaaaggaaggttgtttttcttttttaaaacatgtaacagtgttgtatataaatagtgtatgagtttgtttttgccacttttagctttttgcttcttttttatttgttgagaattgaggagatacattagcattagattcacatctatctaatccttaaaagcaactgttacacttctgacctcattgatggtgactaagttgacactatttttggccctttcttcaatcatttttcatgtctttcctcttattcttgcatctttttatgaatttgttcgtctcacatatttttcttcttgatatgtctataaaagataggaaaagacccttgaacttttaatgagtatgtttgaccaattaaatatcataaaaaatatttttgaattaaaatattgacggcaataatatttttgagtcaaactataatccaagtttttgaccctcttcccataaaagaatgatattttatttttaatgcgatgatttataggtctaaaattcattttggatcacaaatacatagtgatgaacatgttaaacttgtctagatatttcatttagatatttgaattaagtttgttctagtaacatctcaattttttatgatttgttctaggtccgcccctgcataccacaatgggtggaattaacttttttttatctaatgaacgcctgaaagcacacgtaaaaattttctcaacatttaaatacttcttaggagtcgagacaatcaggattaaaacataacttagttcaaatgttaggctatatattaagctcctaaaaaattgtagcatgtcaatgcatgtctcttgttctgcatgtgtgcagttaagacatcatatccttcattcaactacaggtttt

SEQ ID NO: 293 - DNA, 6139 bp, Solanum lycopersicum
ataacaacagttacaaatatgagaatgaatattatcaatacactgaagacaattcattgacaattgaagacttaattttggtaaaaagaaaacatagtaacaaccctatttttactaacaatatcaatataattgccaataatagattgttatttatggataagaaatatttataaaataatattatcttttaaatataatagaatataaaataattctttttgagatatatataataatatttttccaacataaattataaagatgcaataataatgacatatgcaatcgaattttagacatacatcaattagatctacaacacaacaccaacaagagcaatccacaccgagaacaagatacaacttcatgaggggttcaagagcgcacaagtaacggaagtccgaccctgggatcacctaagaagaagagaaaaggtaccttacatagaaaatcatgtatttttctaaatttaaattcaaatattactttcaaatttaactcaatcttatgtagtataagctcacatatatcattccttattaccaaaattcatttcttttttatataataaataatctgtcaattactatataatttgaatttattttttccaaaaaaaaaagaaaaaactgtttttttctttttgcatttggctttattacagtgaataaaaaaacaaagaggaagcttgagctttttttctgggtgcactaaagtcaagaacgaatcccttcaaatttgaattcaaaaaattacacactaaactcacagaaccttcatcacccacagtacaaatgttttcatctgattggtcggtcacttttctattctcaactccaattaaacaaatgatttttagtgggcccaactttgtccgctcctaacgaatacctaaatcaaatggacggttcagattaaatcaaaattcaaatgtatttatttatttatatattaataacttcacatattgagagtaacacacagcgttcttcttcttcgtttatcttgaagaagaggattgatgaaaatttgttgagaaattgttaaattttttttgatcatttttcgatttgaaggaggaaatgatgacaacccagaataggcggtcgtctgcggtggcgaagagacaagcaatggcagcgaattcatcggggttagagcataatcagaccggaaaattgaatgccaagaaacgaccggctttgtctaatatctcgaataatacaactgtctctgctcggaactcggtttctcattcctccaaactcgtgagtatttatctgtttttgtataaatggctttattactctaggaaggtgattagagtactgggtctttctctttctttgcgttttttttgttactgttcgatgattttactgggtttgtctctttttggtggtggttatggtttttttctgattgctggttcagaggaggaaaatgtaggttggttttgtgattttttttttttggggggggggggttctttcttggagtttcataaacattacaactttctcaaaatgatcgaagatactgtgtaaaaatcagtttgagaaaatcaagtgaagtgatttttgatatgaggagatttgtgggttttatttttttttggtcaagattttgtaaattggaagttaatttctttgttaattgacttccattttttaaacaagttcactgttttgtgcaggaaatgcattagttatcgagggatttgttttttctttttttaaagtttgagttgaagtattcttttaatgataagaaagtgttatgaatggaaaatttgaaacaatcttcccccagttcctgctttttgtttatcttccactttgctttttgaatatttgaagaaagttctaatgtttatgttattaagttgaacaaaagttcttgctttctttcaaatggacatagtataattggacaattatgaagtggaccagtggcattctagattattattttcagtgttaacatgaattgtttagcatgtcattactgtgaactagtggaccaattcctgctttttgtctccttagatgattttattactgttcttaattttattacacaaatgagcagagaagttgagcaacttttgctaatttttagttttcacagttgggttaaaccttttctttagtaagctgttttgcaatgtgtgtaaattgaaaaaagactgtttcttgtatctgaagttgtgactaacttgaggtcatttttggctttggaaggcaccatgtacatccaagattgtaaacattaagaagaacacttctgcttgcaacagtaatgcagtttcctcagggactgctgttctgccagcatcctcctctgtgagaccaagcagcaaacctgtttctattcaaagaagtgatgcagttgtgcctaagatcactgtcattcctgttcctgccacttgcagcatggacatttctccatctcattcagatggatcattagtctccatggatgaatctatgtcaaattccgacacagtgagaagtccggaggtcgaatacatagatgaccatgaattagctgcagttgattccatcgagaagaaagcgtgtagcaccctctacatctcagaacatgtcaaagccgcaggttttgatcttttcagcagagaatagtccttgttctggcatttcatttttttaactataacatctatttaatacaatttatctatttttgattccagcagctgatatatgcaagagagatgtacttgtggacttggaatcaggggacaaaattatgaacattgataacaatcttgttgacccacagttatgtgctacaatggcctgtgacatatacaaacacttgagagcctctgaggtataaaaatgtttaccctcttatcttttttaagctcgttgaattggatgctgctgctaactttaaactgaattgctgttttactaacatttatcattaaacatgttttaatgtcatctttgatcactgtactaggcaaagaaaaggccttccacagatttcatggcgaaagtacagaaagacatcaatcctagcatgcgcgctatcttaatcgactggcttgttgaggtaaacttctaatatcttttttctctaaagctatgtccctgatgaaatgtcaacctgcccaacttatgacttaattaatgtggatgagctcagaaattcgtcaatttgatagggaacttgtttgatggtataggttgccgaggagtacaggcttgtcccagacacgctgcatttgacaattaactacattgatcgatatctttcgggcaacctgatggacagacaacgactacagttgcttggagtagcttgcatgatgatcgcatcgtaagaaactaccttctgacctctactgcatatgttttctccatgatctttacaaatttttccttgagtgtttttcatattcttgtgtcctcaattatttcaagcatatctgtaagaaaatgctctaagacattaatatgggaaatgctttattgcagaaaatatgaggagatctgtgcacctcaagttgaagagttctgctacataacagacaacacttacttcaaggaggaggtatatgatcttgattcacagaacctgcagtggtcgaactttgtagtggcactaagacttaacatattatgcaggtgttgcaaatggagtctgctgttttaaattacttgaagtttgaaatgacagctccaacagccaaatgttttctgaggttactattcttatcaagatctagttcttttgagtatgatgatttaggaacttattgttgagatatactgcaggaggtttgttcgagctgctcaaggacttaatgaggtaacctcttcacttaaagttgataattctccaattctataggaaacaagagttgattaaaactttaagatcttcaggttctgtcactgcagttggaacacttggctagctacattgcagaactctctcttttagaatacaacatgctttgttatgctccatcactcattgctgcttctgcaatttttttggccaaatatattcttcttccttcagtgaaaccttgggtatgtacgaattagcattgtgacaatcctataagctgttataatgcattttcgcttcttattctcctttcgacaaatatattcttataaaatttgacttttggaaactcctaatacagaattctaccttgaggcattatactttgtatcaaccctctgatttacgagactgtgtcttggcactacacagcctttgctgcaacaacaacaattctagcttaccagcagtccgggaaaaatacagccaacacaaggtttgcataattctcttttcagttcattccaagcaagtatactggggtctggactgcacttgaacattcatattggaaaattagtgtctgctgaatcttattggataagctatcaacaacctatctgagggataaaagatcaaccttctctcaacactagtcaaatgacgataactgaaaattgacttgatagacatgtattttcatgtacatacagagtcatgtaggcatctgcataaatttcctatcgagtttattctaatgtttggttttcttaaacagtacaaatttgttgcaaagaagtattgccctccaactgtacctgtagaattcttccagaacataagcagctaagccagggagataatgtgagaagaggcatctacttcagtagttccaattgtctgttggattaactcatggcattcggtcttatatagcctttaacttgcaatgtccatggaagagagcttcattcttggtttttctctccttgaggggccttagcagagcatctttgtttgtagtcattaacattgacattgcaggattagtctcttgtactctactgtttttctctggcttagtttgtctagtcaatttgtgtatagaagaagcgccactggctgtttcattagctcagaaactattcagtaatgattcctttatggaactattggcagtttgtgccaattagtattgagaagaacatcccaactgatcaaagccttgacttctagtcctgtcaactggtgcaactcaatatcgagttgtacagaagttgggtgaagaaaaaagacacattgttattgcatctattaattcgctcataatttatattgatcaaggattcaaccgtatacattggcaaaaatattttacagagtcacaatagacaacagatacataattattctataatttacatatagcacagacactctagccctataagagaagttcattgagcacactgaatcttggcagaatctaagccgaaggatgcattagtcctaacattcagccagtgacaatcttcaaaagaacagggctgaccaccgttaggccattctacatccataggttctatgaaagtagggccccaagcgggcgtaccatcctcgtatgaattgtgtgttaatcttcgtatgtctgagccgtctgatttgatcacatatatatcaccatatggctgataatgatgaggattcgagatgggctcagctgatacggcggcgtaatctgaagtgaacactatatacttgccatccgggctgaaataaggatggttagtcctcccacctataccactctggatcaccttcttgagtcctgttccattagggtgaatcatatacatctcgaaactacctgacccagggttttctcgatcggatgcaaatgcaatccattcatcatccggtgaccaattacacatggtatccgtccatggcccctctgtcaatggacgtagaccacccacctctccttccaaagcatccattatgtacaagttcttgtgacctgatctccccgatcggaagacgatccatttcccatcaggtgaaggggacggaaatgcgttattcttccctcctattgtcaattgcttatagctcaagtcttcatcatctacattgatggaaatgatatccacttgtgtgctttcactagcaaatgttgggccaaagctagtgtaaattaccccctttcttttcgggtcccaagccgtggaaaaggcggttctagatgaaatttgacgcagacctgatccgtcatagttcaccacatataatccaggtaacctaacat

SEQ ID NO: 294 - DNA, 2719 bp, Solanum lycopersicum
tgctcatttacggttccattaattatatagtagcagattccacggctaccgacaaatcccagtaaatgctatctacctacttgttgtgtagataaaacaatcaatcttcctataattagcgatccatgattaagcaattaacacacaattattcatttcctatggtagctattcctaatttattccattcaatttgtccagctatttaaaccagtgccacacttgacttaaaaagttttaattaagttgagaataatacagataaattgtactgtactgatgagaaaaatacattacaaggccgtttataattattgaaatatttgttcaaactttgaaaaaaaacttattcatgttattagtttgactcatttctgtcagaattactttttacacctagtcaattatgattcaaccatattgttaattaaattattttttaaaagagaaaaaacttaaatatgttatcaatcaaaaattgatataaataagtcatttttgtaacgaatgacataaataattatttttctcgtaggattataacctcagctcaagtaacaacaattcaaagcagatggatggaaaaaaaaaagggaagtggagaagcatgggaattcatgcacaaattaagaagagagctttaccagaaaaagagacatgttcagatgcccaaaataatgggcctgtagatatcgcacagaaaaaacatgggcttgtggatattgccaccttaaaaacggcccattagcatcagtgacgcatatatcacgtgattagccatatctctaactaactatggtaactttttcaccaaccagggtgacttttaactcaagtccgtcctctaccagactctccaagatcccgacacctgtccaatcaaacggtggtgattattctttcataagttatccgtgttcacattttcctatataatattccgtctcgcttaaaccctaagcacaaatcgtaccatcttgtaagtttgagaaacgtctagtctagagagaaatggcaaatccaaaggttttctttgaccttaccatcggtggtgcaccagctggtcgtgtggtgatggagctcttcgccgataccactcccaaaaccgctgagaacttccgagctctttgtaccggtgagaaaggtgttggaaagatggggaagcctttgcactacaagggctcaaccttccaccgtgtgatcccagggttcatgtgtcaaggaggtgatttcaccgccggaaacgggaccggaggagagtcgatctatggagccaaattcaacgatgagaacttcgttaagaagcacaccggccctggaatcctctccatggctaatgctggacctggaaccaacggttctcagtttttcatctgtaccgctaagactgagtggctcaacggaaagcacgtcgtgtttggacaagttgttgaaggcatggatgtgattaagaaggcagaggctgttggatctagctctggaaggtgctccaagcctgtggttattgctgactgcggtcaactctagatctgatgatgatgatgatctagttttatcagtcttttatgtatttgagtcgccgttttaggctttgtttttaatttcaaactatctctactgctttggtcgggtcgtgtcgggtcgagttctagggttaaccgtaattggttgttgtgttgcttctaccagtttatgtttaatcttaagactacaattaaataagatactcatagacttgctaatgctaatctcgattttgttgcttaatctccaaattttggttgaatgtcgtcatacttttgtgctgaactaagtcatcattttgttgttttctttttggccgataaagatgtgacagtgtgttgacctgagcgtggtttacgtgaattgaatgtattcctccctctcaattgtgggtcctattcgaatataatgccgatattttaaatttgtggtatatgtggatcaaattgagcggtgactcttgtggcgcaccaccgaacagcgtactattaattaaggtgttcttaatttgcttaagaagaaaagttagattactaatccccaaaaataatattcgaccccttccaaaactaaaccaataccaaaaaaaatgtcacttccatgtgttgggtatggggttttagtatttatcttttaggaacactggagtgtgattcgttgaactgcgtgtggctcatttgaatggtagatacagttttgaagaattttgacgtttgcttattttgaaaagattacacattcttgtatcaaattataatttatgtgtgactcgttttagatcataataagaacggctaccaaaagacataacgctgatttatttcgaaaagaacatccgcattaatttttgcagaggaaaaaagttttgctaattagcgcttgtaccttgtaatatttagttatatcttaggtctcactttttcataaattcaaaagataaatttatatttaaagacttttactctgaataatatgcaaaaaaaaaatcataaatattattcctttcgttttatgtgatattattttctttggtctgtgtcaagaaaaatgtcatattcattttatgtagtattatatttttttggtctgtgtaaaaaagaatgttatattttcttatatggcaagtatataaaggtataattcttttttttattttttcttgtaccactttatttttaaaaatactacctaatat

SEQ ID NO: 295 - DNA, 4858 bp, Solanum lycopersicum
aaaacagatcattctttttaactactgctgctgaattgttactttgttttcatccgatttaacaattaaacattcatacacacatgacctgaccacaaagggatgaaaacaaaaacttaactgccaattttttgctttcttaaacaaatagctaataaccaaaaaggagtcggtgatcaaattaaaaaaaaaaagaagttggagactcttcagatcttgactagccatttaagtcaattggttggattgcatgaaatacaagttgcactaaaacttacttccctcggtgaaatgataaaagtacttctagagatcgttttgtaccgtatattaaaaaaaataatgcatgtgttagctttatatattactccttaatcatagattttgggtttgagtactgagtcataccccaaatataagattttgaagcacaaattcaaatatttattagaaagatagaaataaagaaaataaataaattaactctgcagtaaaagacattgctatttatgaagtttttgttacccgaggctcagaaacactgacctttttcctttgtagggcgtggggttttaacgtattaggccacctccctaccacaaatccctctatatttcttttttaaatctatctattcatataaatcaattgtttcgattaatcaagatttatattatttgatatttgaaaataatcaatattagtatcatttaatatttgaaaattactaatttcattagatttttggcaaaataagccagataaaatcttcatttccattttaacaattagactgattcaagtttatatcgaataaataaaatataactatattaaattatgtatttaaaaatttaaatcacaaaacttttgattaaagatcacagaaaaaaaaacccatcgaaccacaaggttagtggtccctgtgtcctttttaagtgggaaaaaaacccatctcctgttgatgtaggagagtctatataaacagagcacacgcttggctaaactaatatgactctctcttgtgaagtataaaggcaagtaaagaagtccataccatttagactactactctgtctgtgaggtggtttggtaacttcttttgaaattttgaggtgcatcaatggccttcttcttaatttttctttcatccttttttggcctatgtatcttttgtactgctttattaagatggaatcaagtcaagtataaccaaaaaaacttgccccctggtactatgggttggccactttttggtgaaactactgagtttcttaaacttggtccaagtttcatgaaaaaccaaagagccaggtaaatctcgattgttcaatcatttatatgataagccactgtgtgttaacataaattctgattataattttgttgtactatcagatatgggagtttttttaaatcacacatacttggttgtccaacaattgtttcaatggattcagaactgaacagatatatactagtgaatgaagcgaaaggactggtcccaggatacccacagtctatgatagatattttaggaaaatgtaatattgcagctgtcaatggttcagctcacaagtacatgaggggtgcattgttatccctaattagccctacaatgatcagagaccaacttttgcctaaaattgatgagtttatgagatcccacttaaccaattgggataataaagttattgacattcaagagaaaaccaataaggtcagttactaacccaagtctttttgccaaatttattttctttcctctgtttttttcctctgttcttatatatacgagttttcaatcagatggcatttctatcatcgttgaagcaaattgctggtattgaatctacctctttagctcaagaattcatgtctgaatttttcaatctagtgctaggcactctttcactacctatcaatcttccaaacaccaactatcatcgcggatttcaggtagaatttcagaatactgttatttatgatgttatctgagagcatctaataatctaggaaaaatatttttcaggcaaggaaaattattgtgaacttattacgaacactcatagaagagagaagagcttcaaaggaaattcaacatgatatgcttggttacctgatgaatgaggaagcaacacgattcaaattaacagatgatgagatgattgatttaattataactattttgtactctggatatgaaactgtttccaccacttctatgatggctgtgaaatatcttcatgatcatccaaaagttcttgaagaacttagagtaagttcaaaaaaattaaaaatcagttaattaactacatggctattttaattttttcttaattttataactttattttttgttattctgcagaaagaacacatggctattagagaaaagaaaaaacctgaggatcctatcgattacaacgattacaggtcaatgcggttcacacgagctgtaagcgtctaatataacacgttaaattacatcgatagtgtataacatgaaataaatcagcatattgaatctatatatatatatatattttgattgtgcaggtgattttagagacctccaggttagcaacaatagtaaatggggttttgagaaaaacaactcaagatatggaaataaatggtaagtactattttgtgggaaaatctcatgcatgttaaattatagttttttatccattgatcgtttttcgcaagttattcaaagaatatctacgcactaacttcgtttatgtgatctttaaaagtaaagataagccgatgatttaacattccaattattattatatataaaacttaaaattaatgtttatttgttatggtatttgagtgattttggtgaaattatgagcatcagatgcagggacaatattcttctaatttagactgattaaaatgtttaaaataataatagatgtatatagtatatgatcatcttttgtgttatggaccctctaataccacaatccacatggcacacctaccattccagcctatacagtttcccttcctgacccatgtgtcgtctcttaaactttttgggaaagtacaatttccctaatattattttttcccatcatataataatttcattaattcacaacttttatgtatacttggtcttattattacttttttatgtgtatctttttagggtatatcattcctaaaggatggagaatatacgtatatacaagggagttgaattacgatccaagactttatcctgatccatattcgttcaatccatggagatggatggttagtatcgttgaaaatcgcgcgtatcctatattatctatgctgaatttgatttttaaatcggagttaacaaataattatggttcttattataggataagagcctggaacaccaaaactcatttttggtatttggaggtggtactagacaatgtcctggaaaggaacttggtgtagcagaaatttccacatttcttcattacttcgtaacaaaatacaggtatttaatatataaacatatataataaaaaaattattaattttatctcgtatttgatgatctgttactaaattgaagttgtattatggtttatgcagatgggaagaaataggtggagataaactgatgaaattcccaagagttgaagcaccaaatggtctacggattagagtttcagctcactaactatcaattcatgaatgtacagagaaaaaaaaattcaaaaaaaaaagagaagagatttgtaggatgcaaagctaagagtaacatgggatgtacaacttaattattattcccgctaacataatcacgaattaaacacaattttttgcagagttaataatcttatacagtgttaattacttttacgcctttgttataaagcaaaaaaaacatacaaataaatggataaacccgaaatcattgaagtactggcgcaaaaaaaaatgaaaattaattagtacaagcccaattaacctttctttttgttgaccggcccacacattattcaaagcccattaacctttcaatatgataaccggcccatacatattcaaagcccattaacctttcgaatgaagaccggcccacatatatttaagcccattaactttactttatttgaccggtccatacatatttaaggcccattaacacaggagttctcagtgtatagtaactcaaccagcagtctggtatggtccaaaggttaaataaagggcttcaaaattttgaggctccaaaacagttttagtagtgaattttataatttatttttttatttaaagtactatagaaggttgtttcaagtacaaaatttatatataattaaataaaataaattatctctttttatattaaattcttttgaactttgaatatatcaaattttatattaataaataatatttttactgtaggatccaagataacgtatgacaaacaaatggtttacaattttattattagaattagttttattttcatgaataataatgttatgaagttaaatgctatatatgttttaggaatactactattgtatctagtctcataagaataaaataagcaaccctaccttgttatttttttggtatatatgtataaattaatgtattttattaaaattagttataagttacaaattttaatcaaaacttttaaatattaaaaataaactgataataaatatatttatatttcattacttaccaaaattagaaaattgttttaacaattatttgttttatattaaaattattaatttaagcctacaaaataagacctacaaacccaataattgttacttatacctataatatattggatctcctttatataattgatcaataattaatatgt

SEQ ID NO: 296 - DNA, 7239 bp, Solanum lycopersicum
  modified_base (1278)..(2122): a, c, t, g, unknown or other
ttccttgtgcctttttagatgacaattggacttttcaaaagtcaaatttgactaattttcaaagttacattagattacgttaatttaatattttgaattgaaaatctaattattcaaaactatacgtaaagtaatataaattgcaagtttttgaatatcattataatgaaaaaatacattttaaaatattagtcaacgtttatcctttgactacgtgaaagttgctctaaaatcaatacatagagaagaaatgtatataatatacagagattgatacgcttcctccgttcgtttataaatgtcattaggactttttaaaaattaaatttgactaattttcaaagctaaatcaaattagataagttcaatattttaaagttaaaatctaaatattcaaaattataaaaaaagtattataatttgcaaatttttgaatatcattataatgttagtcaaagttttatcctgactctaaaaaaaaaaagagagaccatgacaactaaaaaggaaaaatatacaatttattcaattgcaaacttatttaggagactatacaatgtctaatgagagtctttacaatgtaattgttattaattctaattattatttttatgtaaaaatgaaatttaatttattattctatttattgaaaagtcaaagatgttatggaaagttataaattgcaatcttgtataattacaaacttatttgattaaaggcttatttaggagaatgaatactcagaattcacaatacaatgtatctagctataattatttcactctctaaacatggagatatttattaattatgagtcaatataatctcataatttactttctctaaacatggaaataaattcatcttttatgagtcaatataaaactatactaagttattatgactataaaaagttagaaccaaaagaaagtctagacaattaattagccttttgtgtgttataaggtggtattgagtttctcaatcattaggagcatcaatggccattttcttgataatttttgttgtgttttttggattttgcattttgagtactcctctatttagatggattgacattgtgtacaacaagaaaaatttgcctcctggaactatgggttggccaatttttggtgagactagggaatttctaaatcaaggtccaaatttcatgaaaaatcaaagagcaaggtatatatatatatatatatatattctcatttcttttacttctttttactattttgtcttaaatctatgaagggggtttatatgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatttactatgaaaaatacaaagagcaagtatatatatatatatatatatattctcatttcttttactctttttacattttgcttaaatctatgaagggggtttatatgtcaattttatttttttttgtagattttaatatgttttttaaaatccctattacaagatcttatgaactagtatcaagactagaatttttgttaatgctttaggtaaaagaaaaataagaagggtgataatttgtagcaatttcatcacaaattttatttttatcctggatttgtcattaggttaagtatgtttatgaataatgatgtgctgaatgcaaaattagacttattcaatttggtcaattaaagtccaacaatatctatatctatattatatctatatatatatatataagaatattattttcatgaaacttcataaattttaacaacatcatattaaaagacaaaacacattcactatatcaaagtacaagtgatccaatttattaaaatatgaattaaataagctaattttataaacatgtgctaacattttcgattttaacatcatacgttcgctctatcataaattttttattatgaaataatgatcttgttacaatttacaaatgcttgtgatgagccaatcatctatctcaattaaagattattttttccaagtctgtcataaaatgtacgggtaacaaaaagtgatgtactaaaaaagcagataaatctatcacaaacctaaactttattttcaaaacaaataataatttatataacgatcttgaacctcgtgaatatgaggttgatttagtagtcgaagaattttgagatttcaagttcaaatcttaggtattactttttttttcctgaactctcttaatgaaaattttgaatctgtcactgctttagacagaaacgataataattatataatcttgcttaattaatgatgttttttttttgttgttgtaataggtatgggaatttcttcaaatcccacatacttggttgccctactgttgtttcaatggatgcagggttgaatgtatatattctgaataatgaagcaaagggacttatcccaggctacccacagtccatgttagacattttagggaaatgcaatattgctgctgtgcatggtgctactcacaagtacattagaggagcacttttatctctaataaatcccacaatgatcaaagaccatattttgcccaaaattgataaattcatgagatcacatttgagtggttgggataattgcaatgtcattgatattcaacaaatgaccaaagaggtgagctcacaaatctagtatataatatagtagtatcttctttttttttaatcactagtactatgatttagttttctatatacaatatatatacaattaagctgcttaagattccagccttaatataatagggggagagtttggcttgaacataggctcaaacataatttgaagggtccaagccggaaatgatgaaattggggaaaaacatggaagatattggctgtagagagagtgcctatctctcataagagaaggagagtcactgtttttttagagtatattaacgagtaggacaatactagctagggtgtgttaggtacttaggttgggagtctttttttttatttttatttattaaatatgaagaaatatgattttatggataaaaataatatgtgtatatatctattgatttcttgatttttatttcttaagatttcttcgtgatttaatgaccgttaggggtttatattttaaactacggtgatttggacttgatttttatgaaataatttgtttgtgaacgttcttgaagtacttgattatcaagaaaagtctagcatattttgatatctttacgaatatcaagaattcaattacatgatgttcaaatattttgtttacttatttcttttaggaaagatcaaaagttctagtgaaaatagtgaaaacaagttttataaccgggttatataaatactttttgagattacttatcaattattagaaaacacttgtaaagtgctaacaaattgctcttagatggcatttttctcatcattggaccaaattggtgggtttgcaacaagctcatcaatagctcaagaattcagggctggattcttgaatattgcacttggaactatttcattgcctatcaactttcccaccacaaactattatcgcggattacaggtaaataacgtaccatagatttaacttatatacactgataatataattaattacagtatgaatgtgttgatccaggggcggaaaaccattgtcaaactattgaggaaaataatagaagatagaagaggtagcaagaaaattcaacaagacatgcttggtttgatgatgaatgaagaagcaaaaaatagatacacattaagtgatgaagagctaattgatcaaattataacaataatgtattctggatttgaaactgtctccactacttctatgatggctgtcaagtatcttcatgatcatccaaaagcacttgaagaaattagagtaagtatttaattattaatagacattgcttgatttattaaatcgtcttatcagaagcaacctctcttccttacctctgatcaggtaaatgtaaggtctgcgtacattttactcttttcgaccttactatgtggaactatactgagtacgttgttgtaatataacttgtaattttgtagaaagaacattttgcaatcagagaaaagaagagtctggaggatccaattgattacaatgattttaaggctatgagatttacaagggctgtatgtgtgacaatttttcataagattgtttgtgaaattaatgcatgttagcaaattgattctattttaaatattttttattcttctttttttttgtggtgcaggtgatatatgagacattaaggttggcaacaattgtaaatggtgttcttaggaaaaccacacaagatatggaattaaatggtaagaaaaattctgttgatactataggttaaaaaatttatactttagtatgacaatccttataatgatggggatcagtgttctggtaaattactatcactaaatgacttttgtaatatataccaacaaattagcgcagataagaatgttgagatggacgtattgatttactaagagagataggatctaaaataaagatatttaggacaagccggaagtagagtatctcaagtggtgaacaagataaaaaggtgagattgaggcggtggacaagatgaaaaggagatgcatacgaaaatgtcctagtgaggaggtttgagaggttgattatcgtggatttttttggagagataaaggtagatcgaagaaatagtagagagaggtgattagacaggatcagacatatcacacctacaacttattgaggacagttgcccggattagagtgttagaatgttagtaggtaatcaagcatcgtatagtttcccttttcagtagtattattagttctcctaccatcgtattcttcgtttttattattacatgttattttctcaattatattggtgaataatttaacttcttacccttcatttcattgttttgcaggatacatgattcccaaaggatggaggatatatgtgtacacaagagagcttaactatgatccattgatttatcctgacccgtatacctttaacccatggagatggctggttagcaattatactctctctctgtgtttcattttacgtgacaccatttaacatctaaataaatattggacgttacgatatgtaggaaaataacttggaccaccaaagctctttcttgatgtttggaggaggtacaaggctttgtcctggaaaggaactaggtgtggctgaaatttcaacatttcttcattacttcgttacaagatacaggtaatatacaatatatatacatgtttcacaactatattatatatatatatataaaagaattgaatttcttatttgaattataacattattattaatgttgttgtgcacaggtgggaagaggttggaggaaataagctgatgaaatttcctagagttgaagcactaaatggcctatggattaaggtttcagcttactaattatcaaattatccaaactcatgtgtttcctaataaattaagctgcagacttctttttatgtctttattattatgtagaatacaccaaactcatgtttgagatgtggtgtctatatacttttatgcaatattattataatatatgacatagacgttatatatacacccttattagaattattattcgctacatatatattgtgtgtattgtgtttagggtgcacgtgcatctattaattttgaaacaaattaattatatatataatcttgagaaatcgatagaaactgaatatagttaatagtgcactcatgaaaataataaaaggtggtttgacttgcttgtacacgataatacatccatccatgtgacctaggttctctatcctagctacgacctctttttttagcttaatattggtgaattcggagttttcaaaatcctcaatattgtaatttgtcttttaggttgttatacaccatgataattgtggatacatttattattcaagcttcaattatttactcctagaaaaagagaattttattgaaattttcatcttcaataatttcacacctagataaaacccctactttctacattgaaatgatcattatatatgactcacttttcatgatcttcattcacattagagaaagtgatcaaaagccgttaaactatagccggattcataattacacacttatactttataagtatttaattatccttttgaactatttttgattagaattaatgtcaccttatatgctgtggtggcaaagaaagtgcattcactctctttgagagagtgagagacaattctttttattaaaactttaaatttgcaaaaaatttgttcttttcatattaagttttttcatttattttttaaaagttatgttatcttttacttttattaccttttctttataatttttttcatcttctttctttttcttttcggcctttctttggatttaagtcaccgaaaaatttcac

SEQ ID NO: 297 - DNA, 22380 bp, Solanum lycopersicum
gttattagttaaggataaatttatgggaaaattgtgtaaaatagcaaattaataacctaaaataaatgtagtagctaaggtttgatttaattgtgttccatagcaaacgtttgcaaaaaattgtcaagcgcctctctcccaaatatcttgctcgccactctccttcaatctctcgctcgcttcctcactttttatgcaaacaaaagtgtataaaaattgtttctaattgtataaagtagagaaaattgtataaatacatatatttttgttctcctcttccagatctcgcttgccactctcccaaatctcgctcgccaccctcgtctttctcacttatacaaacagaaacgaaatatataaaatgtgtttctgtttgtataaagcgtgagaaaattgtatatacacatgcaagtacatatattttcatcttataaacttataattatacactaaaaatactccgctgcccagtttcttttgcctttctctctttctcctcttatacaattttcaaattgtatctaatttctctctttctcgttttatacaattcgattcaattgtatattccatgtcaagtctcttttgtctttttctctttctcattttatacaaattcaaatagtatataatcgttctatacacttataataatataattcgttttatacacttcatttttatacagttttctgcccaagtgtcaatctctttcttgttttatacattttattttatataatttgcttcaactttatatgtattgagaattatacagtttctatctatgttatggaacacaattatgcaaactttgctatagcatgtaaatatgaattttttatattagctatatgtgaaagttgctctaaatttaacgatacaacaatttttaaaaattaataatcaaaataaaaattggtccaagagatgctcatgttaacctaatttaagtataaacgacgccattttggcattttctttgaactctgtcaacatactagatgtttctcttcattgccgatatatatatgctgtgtctcgttttcccccatttgtgtctcttttctattttcaagtgattcaactgaaacaagtattagggtttgtaggtatagcgggaagagggaagatacaagatgagtgtatggaactacgtggttacggctcacaaaccaacaaatgttacacattcctgtgttggcaatttcaccggtcctcaagagctcaatcttatcattgcgtatgcccttcttttcttcccttcgtttctcatgaactttaatttgcactcccgattgtttctttcttgctttacttgtttctggattttggctttgttgttactatttggggtttcctgatttttctataactgcttcagtccataggagcagtaaatttgcattcagtttttaaaatccatagttatagtcggcattgataattattcctgctgagtatttttttgattattttattatttatatattgatttttccgtgtggaaattggttactaaatgtcttcattttttctcaatttgatttttattaggaaatgtactcgaatcgagattcatttacttactccccaaggtttacaggtgaacaagttctccttcttttaagtttttgaagcaattactcatattttgggcataatttattcaattctgacatttgtttttaaatagaagcttagcaagcttgtaatggaaggttagttctgttctcttttggtttggggaaagagaaaaatgaacgggataaaaaattcttgttaaaagatgataccgatagtttgatagaatatcagttcgatcatttaatccttctgtggtaactgtggtgtccaagctagcttgtgcgcactcgactagcacataatacttgttgtctctggcagtacaagtaccggagaactctatccaccggggtttggattgatggaaaaaaaccatctagtgtttttgtctcttggaatgtgaacataaggtctcatggttttcaaaccacttcattgactactagatcacacctttagattcttttggaccattttaatttaaaaaggtaaattgattagcctaattgaaaaagagtacatttgttcaagttgcattattgaatatcttcccatttgatatctattctagtcacaatgaacatagtcagtacatgtactttttcagttgagaataattctagaaattgcatgctaagggtctatttttcataaattataggacatcaccaccactatcctctgagatagtgaggaggtttttgatacctttggctcgagaacgatagtccaaagcagtctaaaaaaaaagaaataatggaagtacaaaaaataatatactaatataacaatacttgggtttgatgcacttaaactgatggtcttcttgaaacaacttctacctccatgtggtagtggtgaggtctgcgtataatataccctcagtgggatttcattgggtatgttgttgcaatagaacaatactacaacaaaataatacgatagtcaaagtacaagaaaaaacaaatagcaacataaatcgaagacataaaactacaagagtaatattgtgactcttaatttggaagaacaacacgacaatgcactcctacctactaaccttctaccttgatttgtgtccatatgctttttcgatttaccttttacgtctcttgaaatcatccataactaacctgtcatacctcacctttgtactgaggcattcatgcatcttctcatcatatgacattcctgaaccaatctcaacctcgctttccacatcttgtcctccaccaaagccattcctaccttgtcttggatatcctagtatgctcacacatctatacaacatcctcatctccaccatttccatcttctgaatgtgagatatcttgatgggtcgatacttcgttgttaataacctagttcatctaaccaccactcggtagaacttgacttgttagttttggtggcaccttctagcacaagggtcatttacaaggtggggacatcttttatgacttacctaggttgcttccacgagtgccagttaaagattgctcaatatgagattgaaaaagtagaggaaaggttatgattacaataaagatatttgtccaaaggaagtgaggtggcattgatcaagagcatgtttagtattttgacatattatgtgtcaatggatgcacttgttatgggctccaaaattggtttttagatgaaacattttgggtgatatgaaggatgagacaatagactcacctagtgaattttttcaataaagtatgaaggcctcattgtgaaggaatccaaggtctccaacaaaactcacttactaaaatggcttaggggatccaacaatgagaatgagttgcaggcgggtcttcaacaacacttattaaaatggcttagtggatccaataatgagttgcagactaattaaggagtagtaattgtataattagatatccaagaggggttgatggtgttcgaggactgacaccaccatgttgccttgttggtgcggagtagggagaaactttattaaagaatttcgtgcaacatcattttttaagtgagagggaaacatattctcaggaaaagttagatggaaacaggctcaatatatgaaagtataggtgttgtagagaagatcctcattgacgcctatgtcatatgaagttagaaagctatgacagttgctcaagtacataaggtagaacaccatgacattgtttaagattgagattcaggcaaaacttgtttaaaaacttgcacaatttttctgtgaggaaaacattatatccttgcaccaaggttcttagaattaggagaggggaagtttactttaaatgatggagccaatctaccaaaaaggcacaaactaccaagagaagaggatacattaaagctctgaggaaggtttgttttgtttttcacttggctagccgcgaagagactcattcttatggttaaacaattggttaatatgtacagatgtttggaagggaagattgatcgcttcttgcaactcaattatggtggaaaatattagatctttttggaataagtgagtaaatctagaacatttattaataaaatgatattctcatttttgtttgtgattgcgaaatttatcctctatattcaaaatttgtcacaaataaatttctagcatacatttctattaagaaaccgaaagaactatagtgaaaaatgtgatattcacttggtttgacatagttatacttctcataaatgatttcaagtcctacaactcgagatatatatcagttttctaaaatcaaccttcccgtggttgttaccaattcaagatcttgatcctggtcaattggtttttgtgaattgaaagaatcatacaaatttgggtcaaatgtctaaccattgtttccaattcaagatcttgattttggttggattttgttaagtgtacattgggggtaaagagatggaagagattggaggagttcaagatgatatatagaggaattttccagtgttacagtaggcaagaacagagaacctgctaagcaaaccctatttgtgcatgctttttaatgaccaatcacaaatcattggtcctggcaacaaaaaaccattgaacattggcatggttatggaagtgcaaaaagaagaggagcaaaggagcatgcattagatccggaagtcgagcaccaacaaaatttgatggcttaattttctcatagggtccaaatgagcatcctctcatgcatggggatctacataatattgattgattcttgactccatatctcaccaaggtagcaatctatgtaattttcaaacgtcaatgaagtggtgcaaggataaggtgaaatgttttctgtaaaaggagccacctagggatggtttgagcctctatttagttagaaaccatgtagtaccgtagtacctctatatgatggatcttggcaagaatgtgtgggcaaaagacatcatgtgtctataatagagttaaatctgttatctgtatgaacattgcttttgatattttttgttgaagtatttctttgatctccatgcttaattaggggtacgtggatttgagttgtcaaaagaaaaattcatgtactggcccaaattcgcatgtatactcaattaacagctgaatatggagatggttaagcttcataaagttcagggcaataacttcagatcatggcttaacgtttggtagtcactttaggaggattttttggggaatgttacagagttacaactaagaagtgggatgtagtataatcatatgctaaaattacttttgtcctgaagaagttctataagaagttagagaaatacaattctgagcctggtgaatagtgtcgacaatcatgggtgtcacagatcctattccatttgtggaacatttaatcatttaatgcagaatctcatctttcattgaatcactagatttgagttcttcggcttgaaacgtgttcatctactgaaatcaggtcatgttatcattgtttcgcatcaagattttgatgttggtcagttgattccttgttaactcaaagaattatatcagttagtgcaactatatggtatcatgttctagattttatattagttttaactctgtcatagtggaaaacttagtatttaggtaatatgtttgtttactaatattccttatttccaatagccttaagtccgcagccttttatattataagtcttttattctgctcttttctcttttcatgcgcttttaaatcacccgtatttttgttgtatttgttttttcctgttaaatgtaagaattagtgattctcatttttcactgttctaatcttgattaagatagtaagtgtttttcgttttttagaatattacaaaatatgagtgcagtttagtgcatttgtctgcagcctatgttagatgtgccaatatatgggaggatcgcgacacttgagctttttcgtcctcacgtaagttgacatctttacgttctgtagttcatttttatcctgcaaaatatactggacacaagaaaaaattttcttttgtccatgtcagtttttcatgttccctggtatcctggcagggtgaaacacaagatcttctcttcatcgcaacagagcgatataaattctgtgtccttcaatgggatactgaggcatctgaagttatcacaaggtaagtctgcaaaactacaatacctaatttttatttagaagtttttttttcataaaaataaaattgacaatccattgaatagatattcagtttcagatttaaaacatatgtatatagaactatatcctcctacttatcaaagaagaaagaaaagaatagtcccaacttgcttgggattgagcttagttgtactgtaatgcatgatccatggtgcagtgattcatctttatagctttttcatagaagccttaatagttttttttctctctgcaaaaacttcctcaaaagttttccatgaaaatgtcattgtttattcacaatatatcttcttgcaaatcaatgccagaagtggtctagccttatgtgtcttatgtttttgctagttgctgaaggttttttaagttttattttcattactcctagcagaatgtatgcctattatttgctgacctccatatcttttggagtcagcgtatatgtttgtttctcaaactcaatactcccctcttttggtgttctcatatgtagagcaatgggagatgtgtcagaccgaataggccgtcccacagataatggtcaggtactatttttttgagattcccgtgaatattattgttattttggaggaataaaatgttattttttttttgtttatttcccattcggtctatgagattctgtattgtattcaatatcctgttttacatttgctgcttgccctttttctctcttttggtagattggtataattgatccagattgcagattgatcgggctacatctttatgatggactatttaaggtacaatcgtacaagactcaaaaaattggccacttggtctttgtttcatctgtttactgtattagcttttgtggtggtttctttatgtttgcaagagattctcatggagttcatttcaataggttattccatttgataacaaaggccaactgaaggaagcttttaacatcaggtatccttagatctttcaagatcgtgaatataacttatctgcaatttcctcctaaaatttagtaatgtcttctctttgttgctaaatattttctagcccgtgcgccaatttgcttttcttgtcttacaccatttctgtatcacctgcctgattggtaaatgatcctttctatcattaaattataatggataaggcctgtgtgattggtacgagtatgcatggatgtgcattttcttggagcaaacaaagaaaaaagaacaatagtgaaattagttttgaaacatgagatcaatgcttaatatgtgacaataatcgaagtaggggctgcactccaaatagccaattagtgtaaaccataggagacgagggtatatttccagaagagaaaaaacaggcgatttttgtgcacccaagggtgtgggcctggtggttaatgaagctattcaaatcctagtagtggagaaaaaacatcgggtgctttcttcccatcttcctaagctttgatggtcagagttactcagtacctgggctggtgggaggcagcagactagctggtataaggtggattagtcgaggtgcacacagatttacccatacaccaccgtcatatagaaagataatttcttctatttttcctcagattttgttcggcaaagttatcgtgttgtagcctgttagcttccttggtgggaagtagaaggtataggggagtagttaaggtgagcgtgagtttgtctgaaaattatgggtctcaaagaaaattccaggtcatgacctctgcaagtagacttgtaagaccaatggttcattgccctttaccagattaatttatagtgatcttcatactccttcttgtatattctgttattccaaatttatttgtttttgttctgtaatcttattaacttgatgtagatgaaaacttcaaaggatttctggactgctgttttcattttctggatatttattgctgcactttgttttctctttccttagttctcctaagtaagtaaaattctttctggactatcatttcgtgtggtttggtcttgggcaggcctataaatgtgacctcattttgtgtttcaatttacctacatgtcttgtgattgattatctgaattatgttcctaagaagtgtatcctacactttatgtaggaagtttgctgattaggtctgaatctgtttcagcagggaatctcactttgttatttatggtagccattcttcattgaccgatagttcattatttcttttttttcaggctcgaggagcttcaagttttagatattaaattcttgtatggttgcccaaagcctacaattgttgttctatatcaggtctgtgatcctcaaaataatgttgacatgatgcgtaatttaccatttctgttctttctaattatggttgaaaattgttcatttcagcatggggagtgttatttggcgccttagagtcttggatttgttgttagcacttcgttatagaatgaagttgtgcacttcctttcttttaatagaaatatggaagagggggggggggttctgaacccaccaaagggcttcatttgcacaattgccatggctcttttttcagtttaagttacttcattctgatgcttgttctggaccttttatgtttgattggcaggataacaaggatgcccggcatgtcaaaacatatgaggtgtccttgaaagacaaagattttattgaagggccatgggctcaaaataatcttgataatggagcttctttgctaataccagtacctccaccactgtgtggtgtattgattattggagaagaaaccatcgtttattgcagcgcttcagcttttaaggctatcccaattagacctgtaagcacatgtacaacttactaattttccagtcttcttgtacaaccacctccaccagcttatttaacctgaataagcctttcaaaactttaaactagatgttgtcaaagatgctgttaattaaatacatgaatgatatattgtcttacaaatgctttattgttctttcaagtctatcacaagagcatatgggcgggttgatgctgatggttctcgatatttgcttggggatcataatgggcttcttcacctacttgtaatcactcatgagaaggagaagtgcgtcagcattttctagactgtcatttctactttagctgagttgctgggaatgaaatcttctcttgtacccctgcctggttgctggaataaaaatgtttaatttggattgttaacctgttttccagagttaccggactcaaaattgagctactgggggaaacttctattgcatcaaccatatcatacctagacaatgcttttgtcttcattggctcaagctacggagattcacaggtacttttaactgttgagtgcatcttggtgcaataagttggtttttagagctgccttattgtattttccatacagtagcctttcattcatttggaacattgaggttttaaatttcagttgcctatttctggtggtgcttcatatttcacagttccactaatatttttgaattcacgtttagcttgtaaagctcaatctccagcctgacaccaaaggttcttatgtggaagttctagagagatatgtcaatttaggacctattgtggacttctgtgttgttgatctggaaaggcaaggtcaaggtcaggttgtaacttgctctggagcctataaggatggatcacttcgtattgttcgaaatggaattggcataaatgaacaggtttgtcatctaatttatttttgagggaattcttactatgtattcatattgctagaataactttatctgtatgtaatgctcttttataggcgtctgtggaactacaagggatcaaaggaatgtggtctcttagatctgctactgatgatccatatgacacattcttggttgttagcttcattagtgagacacgcgttttggctatgaaccttgaggatgagctggaagaaactgagatagaaggcttcaattctcaagtccagaccttgttttgtcatgatgctgtatacaaccagcttgttcaggtatgccctgcattgagtagacatttttcctgagtgtaagattttcttttaatttgacttatcagctagatgtaagtttgcaagtgttcagtgtatgtaaatagaactagattttttgattctataaatgtccctgtctctctcactgcgtggatgaggacaatatggaataatcagctatttgctactgagaaggattggcaagctgttttaagagccaaacggacttggtatgacaaagttggaaggaatagaattatataaaaaagaagatagggtctttcacactgacaatgggcagcatgacttatccttgatcccaccactggttgtacagatagggtctttcacactgactatgggcagcatgacttatccttgatcccgctactggttgcactttttaggtttctatggatttcataacaatcctacggatagggttcttatctacctccaggtaatgaatatgaaacacatttatgatttgatcgtaagtgtgattcagtattgatctattagggggattatgtactttagggtctatggaattggctctttcacaccgacagcaagcaaaatgatttttactaccagtggttgcatttttaggaggtctttattgttttcataacaatcctacatatgaaattcttatctacttccaggtaatgaatatgagacatatttatgattagatcaaaatcgtgatgataatatatatctgtttggggaatcatatactttagggtctaaatggaattggtatgttctaaccttttcgtttaggattgtattggtgttacttttcaagtatgaaatgctcagaagtggattacaaaatctataaattttaagtagccatctgcagaaagatgatttcttctccataaaacaaaaggtctgagttatcacattgtgaaactgattctttccttctctaaatttcgatggtctccaccagtgcttggtactctttcgagttagttatatgcatcctgtataatagttttgaagatttgtttagtccttcccctataacactatctcaaaatcacaggagttcgaaatgaaaaagattaggatggaagcatcttccttcaatatcttctctttctggtttgttatgtgcatcctgtaaaataattttgaagatttgtcaagtccttccagttgcactatgatattatcgcataatcacagaagttaggaatgaaaaaatattaggactgaagcatcatacctcaatatcttctcttttcagttaaaaataagttgccagcttgtgtggctaaattttgccaaagttcttatgtgtgtcatcttccattacctttctctctgcattactttggtagactagtaaccaatgatggtacactgattgcttagggtataacattttcattaatatatatgtatgggtgaaatctatttatgataatatatgtatttaaggacagtcgcacataatgccatgcaggttacttcaaattctgttagattggtcagttctacctctagagatctgaaaaacgagtggtttgccccagtcggctactcggtcaatgttgcaactgctaatgccactcaggtttacctcttgcattcattcaggactttataatagcttgagacgtgcaaaagactgttgatgataaattttgaaaaaatgtttattagctttatatatcatggttgtgaagtatttctgcctccaaaaagagataaaaactgactacgataatgacagatgccgttggttgtgacattggcaataggatacagatcccaatgcacaactacacaatttttaagttatatagtttccagattttattccttggcatataagtctcattttctttgttggtactaaggggtcgttcgatggagtgtataagaataatgctaaatagaatgtattagtaatgcttgcattaataacaccaattttttcttatgcattgtttggtttggtgtgttaaagatagtatgcattgcataaaaatatttatttacaaagaaacccttcacaattatggtggaatagatgaaaaagaattgagggggaatgagatctttaaacatgctaatgcatgtattaaaaccccttgcattattaatacctagaaatccatgatataggtaatacacacctcgacacaccaatccacgatgttagtacaacaaaacattagttatacatagcatgaaaaagtataccaaactaggtattactaaatgtcacgactgggcattaccccctataagtaacacagtgtactcgacctctcggaggtcgacatctttcatcgcatagacataaaatagtgcgaaatttgaaactttttcacaatataacactaggctaaaagtcatctcatttaaaacctttttgaaatacaatggaattaccaagtctcgatgtagccatcttacaacacaactacaacacaaaagggacacgacccttataatacaaaagcaactactatctagtacatgaacttaaagaaaactcttaacataagggtccttgaattattaagcacacatccgaacttgggaatagtaatccaagctcttcattctaggaaaggtctactagccacaaccacctacacttggtataaaaagatgaagaagaatggtgttagtacaagaatgcactaagtatggtaaccatgcaaaaacatgctttaaagaggacatttagttggaaaccgtgcatcatgccattttagagaaacttcatgaacctttgatacaagcacaatatagttcacatacatcataatagacatggataccattcatgacaagacataaagtcatttatcacatttaagacattcaatatctgcaatacgttatcttccttattatcttaactccttgcctcaagcaacccttaagtagtacttagtgaaatgtatgaatagtgtcccctttccaccattcacaccaaagtatcaccaaaggtgaacattcatacaaccctcatcaattctcatattatagactagaagttagctcacttaccaattcgccaagccatgatcaacatagatcaatccatcataattcataatcaatggatatagatagtaatcaaatctaacaatacgatccaatccaagtacaattcattaacataaaatcatattcacaaagaaccacattatatgccaatttggagaattaggaggatcaagaatttccttaggaaatcatcataagaacactaatttattatttattcatcattggaatgacttagaaaatcgtttgacaaggaacccattcttagattgaaaattgggaaatttgatcattgaaactcttttgaaagaactccttgaatgaaagtttattcaagaatcaagagttaccggacccatgaaaattgaagaagaaatctattgaaaatccatctcctagcttgatcttgagcttggcctccaatggagttctagagagaatctttttgggggggaagggtttaatttttttgaagaatgaatcctaattctaggtttaggggttttaaccaacttaaaatgcccaggaatagataaaataaccatcccccaaataaccaaaacaccccaacacttaattggacttttagaaacttccaactcgacttttaatgacgcagccacatctgggacatggctgcgcgtcgcggaggcacctcaataatttgttacatgaattatttttttggacggtaagcctcgtgacaaacgcgagatgcggaggcatgttgagtgccaagccaacgacgtggactggtctcctcatcttggtcctggtcgtgctgccttggcagcttcttggcccatgtttgggtcctcctcaacgatcctttgggctgtccttggggagtcatacccgaacgttttgaccctaaacatgatcattaagacattagggtcacttccactgattatagactccaaacgacacaccgaaacaaggaaaacatactagaacacactagcacacaaaagactagtttctggacgtcttgattgtcccttgacgtttgacttccaaactctttacaactgacttcaaagcccgtatttcattattttaacaaattaataactcataaaactcgtgaggctctagctcatcctatttcattttgagggtcgttaaactaaaacacaaagtaaatgcatgcattatttttgctaatccactttaccaaacaacccttaagtttttttttatctgagatagcaacagtcttgcatatgttgaaacaatatcttttaagtaaatctgtttaccagtaattttgggagcgtgaagcgagaaaaagcgtcaaggcccttgtttgcttaaaacctggagcaaatcgctcacttcactgagagtgaagcacaatttaaaagaaaagagaccaaacgaaatagagacaatatctaccttcaaacgttaaaattaaaaactaaaaagtagatatcatgaaatcttccacagaccaaaggacaaaccaaaccaaagctattaatggtttctaattctctttcgtcgacaagattttgaccatcttgtgttcctccactatcattatattgttcaacatcttcttcagctccatcattatcttcttccacttcatcaactagcgacttgaagctacttttcgtcctcctatgtaacgcttgcagtatccccccttaaaccataatagttcttctcaactccacttgtgtctgcagcaccagcccaagtgaaatcagaatctttctcaaaaattgcttcatcatcatgattctcaggcattccagttacccattcataagcatcatctatattgtccaaaagaattggatcaattacattgtcttaatgacgtcttaatgttctattttattttatgaactcaagttcattgaggcgctttagggttaatgtattcctcttcttggtatgaatctgtaaatcagttgtggcaagtaataattagtagaagtaataattagtagaagtgttgtcaaaagcaaaaatctaaaagaagctctaagatttattggggccttaaagctctcaaatgaagcacggactttaattgaaaaaagggctcaaagggagaaaaaatataaatatatatgtttagtccatgatgaatgaatataaggatgacagaaaatgaacaacatttacgataaagtgaaaagtatcttggcaaggaaaagtatgtcttagaaccttgatgacgacattgaaccacaaattaagcgaggtgaagtgttcaacatgctttgagcctcgcttcaaggcttaagcgcatctttagaaacgttgattggtagaagttaagacatagatgacttcagtttcttgaacaagaaagagttgtgatttgcttaactatgtaaaacataatgtgaaagagataggttgttttagatctctcagcaatatagtttatgaaaccttgggtaaatagtactactatataaaagttatggacaatttttttttggatgactagggaaaatctactactgctaccctttgagtgcgcataggctgtgcaatagcttgcaaaccacataggagaggtaacccgcactaggcaagcccggtgtgacaagcttgacccagaaggcaagccctttgctttcactggtaaggggtttcaaactcgagacctctggtctcgaaatatggaagtcccaagcccaaattacttggccacccggaagggtaaaagttatggagaatctgataagacttgaatagtaaaatcacttaattaaatgattgtaatttttttagattactcaatgtagaaccaattgaaccacggacaccttaggatgtttgttggaaactatagtttttttccccaggtcatggtttacctttgttagttacaaggttttgtcactccatcttctgccgattagctcatgtgctgttattttctattacaggtactattggctactgggggtggccatctggtatacctagaaattggtgatggggtgttgaatgaagtaaaatatgccaagttggattatgatatctcgtgcctggacataaatccaattggtgaaaatccgaactacagtaacattgcagcagttggaatgtggacagacataagtgtcaggatatattcacttcctgacttgaatctcattacaaaggaacagctaggaggggagataattcctcgttctgttctgatgtgttccttcgaaggggtatgttctcttatctttacagtgaccttgtatatgtgcttcaactatctgttttcttttggggaatgacaaacagggtattacgtttcatttctgggactgtcctgtgcagaaacctggaaaacaatgggttgaaggtgggttgccccgttgtctctgattgtgggctctttatgttatttttttggtaagctaggcgtataggctttcttagtaggctaccgttagaatggaaactaattactaagttctgatagtttcaaaatttatagatttataactagatatgtttgttagttgtgctctagaatcacattaggtttttgttaaaaaggatagcttgatagttcttctattttagctagcccctcaatctagaccaactacttttgtttcattattcataattcctgtagaatctttttactgttgcctagtcctctgtgaaaattgtcaaaaatggcttctggcatcattactagaatagcccattaactcaaatattgttccacctacttttctcaatcaaccttccagtcaagggcaagaaatcatttagatttctatctgtcctgtgttacgagaattttgtgatttttattttctagaaaaagaaggtaagctaagggaggaaaggaagagtttaaaagtgggaaaaagttgcactgggttgcatcttttcaaaacgctaaccactttctattcctaatgtattctttttctttttactttttccctcttagctggacactattccacttacatttctgtgttcgtatgctaatataaatttaaaaaagacaagatattagaaaatatcttccctcacctttgatgcgaaaacattctttctaaatgacttcctgatgtattttgttttatatggaatctagtggttgtggttgattgaggtgaaagtgttatctacggagctaaccgagaggtaacaaaattataatctcctctcccactcacccgttccctagaaaaaaagaaaagagactaaatgatgagctcgggcttactgtgtttttccttttataaagatacttggctggatatattatacttttagtttttcttttaggcttaaataactgccggaaagtttcaagtcaacagtctctctttcacttttttttgcttttggataagagtaatgagattttgttaatcaagagaaatctacgactacaaagtaggtagtggtgtaaaatcccgctcagtgggattttaggtatgttgttgcaagagaaagaaacacccgtgtacgagaagtacactaaaaagtagaaaatctcacaaaagatacagttttctacaaacaatttctgatgttgtatacataggaaccacttgggtccaccaaaatgaaataaggataagaggctattcctcatatgtacataattgtttcttagttttactatgtaattttatattataggaaaatacaacttagaaaagcaaagtaaaagaacaggagtcacctcatggtccttaaaataaagaaatgaaataaataaactgtgtacctcatgctttcttttctcccattagtattttatttccaataacagtatctgcattatgaataaaagatagcaaatagtagacctgtgactgtttataaatcttgccctgaaggtacatcaagacctgaagcgttttatgattgtaatacggttatcaaaaatataaaaataaatcaagatccaaaggtgtttgaatcaacaagggacgttcagtgaactgaacagtagaatttcttgaagcctagattatgttacttcctaagtttgggtacagttcatctttcatcaaactgactagtgtagttagatgacaagagtaaagagtaagtatatgacagcagatttgaatgactgatacttgattagggtttgaatatatcagacaatagacatgaaattttatgacagcagatttgaatgactgaattgattagaattttgaatttcaaacaatagccatgaacaattttgggctgcccgcctctaatctaatatgttcttttgcctctgtttctttccttttttggggttctaaactatatccctttcagatatcttatctactatgtgctttgggagatggccatctcttgaattttgtattgagcatgagtactggtgagctgacagataggaaaaaagtttctcttgggacacagcccataacacttcgtacattctcatctaaagatactacacatgtctttgctgcctccgataggccaacagttatttacagcagtaacaagaagctgctttatagcaatgtaaatctaaaagaagttagtcatatgtgcccattcaatgttgcagcttttccagacaggtaatttgttccttccttttcttcggttttactggtaacattgtgtcctgttcactaattgttgaatgtggcactccattggtaatttatatctgtctattaattagttgttcaattacatttttgagcacgaattgctagctcaggcctcaggcacctattactggtgtcgacatgttaaagaattaaaatgtcttccatattttgttgacaagctaatgttaagagttgatttttgccatatcttccaagtctgtcggaagtatcgtttttgtcggttgtagtttcatcatattttaattaattgtatcctatattttctatgcctaagtagttatttctcttttgtcaacagccttgcaatcgctaaagaaggtgagttaacaattggcactattgatgaaattcaaaagcttcacattcgttcaataccccttggggagcatgcacgtcgcatcagccatcaagagcagacccggacatttgctctatgcagtgtgaagtatactcagtcaaatgcagatgatcctgaaatgcattttgtccgcctgttggatgatcagacatttgagttcatatcaacatatccccttgaccaatttgaatatggctgttccatactaagctgctccttttctgatgatagtaatgtgtattattgcattggaactgcatatgtgatgccagaggaaaatgaacctactaaggtaagtttatttgatagaagattctctaatcataaggtttgcttagatcctgtgatttgtaatgaactatttgatttcagtagttttttgggcgtcaaccatattgttttcctatgagttcatctgatggaactttaacatattcccatcattgtcctcactttgtccccctacacagaggtctggtaacttgcgtctttggtgatcttttatttggactgttctgcagtttcaacttgatctttgtattccttgcttaagtgagatgtgataacaaatatgggatggatggagggctgcactgaaaactgatgataatctttatgattagcttgggagagagtggagtttaaatcattagtatctagttaaacaaattaatcctttacagggagcaagttgtggttggaagaaatatttacaccttgaggatgtttcggttgatctaagtttgtttcaaatcaaaactgataacttgtaacttgggcattcaatttaatgaagttaattgtttaattactgatgttcgtttttatggttacttaaggtaccttaatgatgagtaaaattgcagggccgaattttagtttttatagttgaagatggaaagctccagctaattgctgagaaggaaactaagggagctgtctactctctaaatgccttcaatgggaaactgcttgctgcaatcaatcagaagattcaattgtacaagtgggcttcgcgtgaggatggtggcagccgagaattgcagacagaatgtggacaccatggtcatatattagctctttatgttcaaacacgtggggatttcattgttgttggtgatttgatgaaatccatttctctgctgattttcaaggtacctttcggtagtaaatacagtgttctaatgctttagattttaaagttacaacgttacttttaattcctagcttcttgtcattagcctaattcatcttacttcagtaagaagtcattgctgacatttacggtatccttcttgtttagcatgaagagggtgctatagaggagcgagccagagactataatgcaaattggatgtcagctgttgagattctcgatgatgacatttatcttggtgctgagaataacttcaaccttttcacggtcaggaaaaatagtgaaggtgctacagatgaggagcgcagccgtcttgaagtggttggtgaataccaccttggcgaatttgttaataggtttagacatggttcacttgtcatgcgactaccagattcagatgttgggcagatacccactgtcatatttggcacagtgaatggtgttataggggtgattgcatcactacctcatgatcaatatttatttttggagaagctgcagacaaacttacggaaagtgataaagggtgtgggaggtctgagccatgagcagtggaggtcgttttacaatgagaagaaaacagtagatgctaaaaactttcttgatggagatttgattgaatcattcctagatcttagcaggaataggatggaagagatttcaaaggctatgtcagttccagttgaggaactaatgaagagagtggaagagttgacaaggttgcattagttgaatctttaatggtctcaactctgtaatatttcacatttcttaattttttcttcttcttcttctgtgaggttgtgatacaagttcttatccctatatctgtacttattatctcatatacttttaatagctgttgaatttttattttaagttgaaaaagaatcatttgcaaacccaaatgtccaattttttggctcccatttaattgcatcctacggagttgattgcacgaattgaccttaaatggtcctttttttagcccttgaaaagggatggtcattgcaatatattacttctcccgttttgttttattttatgtgagatagtttgactcgacataaagtttaagaaagaaagaaattattttaaaatttatggttcaaaatgaatgataaaaaatttatatgatcgtaaatttattgaggataaaatatgtgctttatagttaaattgttattcattaaaaaatatgtttttttttaccaattgaaaaggaaaataaataacataagttgaaaaagtcacggaattggagtaattctctgtcatattacaaagaaaagaagaaaagtttgatgtcaagaatgattgataagacaaactttatactttatatagaggtagtcaaatctatactttaaattaaaaagtgaagtagattcactgtgtaaactaaaaggtgatttaatattagcaaaagatattagaactgtcaatctctatcatacacaattcaatctcttaattgatgtcattttcttttgtatttttgtttctatcatttccctataccatcctcttttcccttcctcacaaaaaaattgtcattacttattccttaactataatatttatgaaattatacctgccttcctttataaattagcataaatatttctctacagtaaattatctgtgaaacaaatttaataaaataaaataagaggttgtgaaccatcatttgtgtgagatcgaagttatttcttatgcgacacatctttttaagaataattgctaaataaacaaaacctacctataaatatgtatgaatttagttaaatttatgtttattagaaaacttataacattacctttaaaatctttgttgttaaatgcaacaaactcgagaatgattctaagggactgtttggttactgcttagagttatgcaggtattagctatgcagagtttaattatacaggaattaattatgtagggtttagtatgcagat

SEQ ID NO: 298 - DNA, 3752 bp, Solanum lycopersicum
tagattatccgtcaaagtaagattaaaatttggaaccataattaatataattaataatatctcaaagcattagagtcgtgttcgcaacatgtagaaactttacatttgggtgaaaacgaatatatatataattatatacttcctcatgtttaatttgtcatagtttcccttttgtaaaataaattataaaaactttagctaacaatttattatgatatgcaacaaattgtaatttatagtactttttgtagaggtttttaatatcgaaattatttatttgaaatatcaaactaatataatctaatttaactttaaaaattaatcaaattgatttcaaaaaacttaatataacaactagaaataaacagagaaagtgtataaaaatttaaaaaattctactcaaattaaacataatccattagaactgatacaaaacttttttaaaaagaagttaacgtggcaattttttctactacgaaccggaaatttataaaatattatagatatagttattgctccttcaatagtctcttctagaatcacattagaaaattgctatttaattatttgttgaagcttcgtttccctaatttcaaaatacaaatactctccctctcgtatcttaatttaatttcaaacttttcactttactctttaagtaattaaataaatgataaattaaatgctatgggcttatggcctatgtatacgcaagaaatcaaattattatattatcataaagcaacttgatgtaccatccaaccccatgtaatacaaaattacaacttatatgtgttgtgttttggttgctctgaatgatcaaacttttgaattcaatgttttcttagccgcctgtaagttgctgtttgtacttattagaataatgtaatagaataccctgtttaaaattacttaacctttgacattatttcttcaaaaaatttctataaatacatcacctacaatgttaataaaactcactaaaccaaaataacaacaccaaaacttgttaagaaaaatgtcttcttattcagagctatcaaatcttccgattcgtgaaattccaggggactatggtttccctataattagcgcgattaaagatcgatacgattatttctataaccaaggtgaagatgcttggttccataacaaagctgaaaaatacaaatctactgttgtcaaaatcaacatggcaccaggtccattcacatctaatgactacaaattggtagcctttttagatgccaatagctttgtttgcatgtttgataattccctcattgataaaactgacactcttggtggtacatttaagcctggtaaagaatactacggtggttatcgtcccgtcgcgtttatcgataccaaagatccaaaccacgcagcattaaaaggctacattttatcatcattcgcaaagcgacataacttattcattcctctgttcagaaacacgttatccgatcatctttttaataatctcgaaaaacaggttactgaacaggggaaagcagatttcaatgctttgcttccgactatgacgtttgatttcatttttcgtttgctttgtgatcagaaaaatccgtctgatacagttcttggcgctcaaggaccagaacatctacgtaaatggcttttcccacagctaattccgtccttgagcgccaagaaacttcctaacatcatagaagatatgctcttccataattttttaataccatttggttttataaagagtgattacaacaaacttgttgatgcatttagcaagtctgctgtgtccatgttggatgaagcagaaaaacttggaatcaaaagagaagaagctgtacaaaacattctttttctcgtggggatcaatatgtttgcggggctgaacgcctttttccctcatctattcaggttagtaatgtcgaagtgtgtaatcatctcatctaaaaatttagttagacagaacacacttgattattctattctgctttgataccatgttgaagtgtgtaaccatctcatctaaaatgttattttcatctctcatgtgattaattaggtttgtgggcgaagcaggggctagtctacacacacaacttgctaaagaaatcaggagtgttattaaagaagaaggtggtgcaatcacattatcagcgattaacaaaatgagtttggtcaaatcggtagtgtacgagacattgagacttcgcccaccagtaccattacagtatggtaaggcgaagaaagagttcatggttcaaagccacgatgcatcttacaagatcaataaaggacaattcgtagttggatatcagcccatggctagtagggaccctaagattttcgcaaacccggatgagtttgtacctgataggttcatgaatgatggtgagaaaatgctgaaacatgtcctatggtctaatggaagggaaacagagagtccagcaccagataacaagcaatgtccaggcaaagatttggtgcacctattgggtaggttaatattggttgaatttttcatcagatacgatacattcaccctggaaattacacctctatttcgtgcaccaaatgttgcgttcaacacattaactaaagcaagtaaatagtttgttatgtgatcaaactgtgtgtgcccgctcacgttgcatattctcttattgattattttatttttttggttgtatttatttagtttttgttgtaaatcttctttatgattcaaatgaataaacgttgattctagatcggatcaaaattgaatattacaggttgtggatatatatcttaattcttttatttcaatttatgtcatgcttttttcttttaaagtttatctaaaaaaagagctttttatcttttcgtaattagaaatactcttttttgagatttttttgataaaataatttatagtcacctaaaaatttaagatttattttaaaatataaatttcaaatgcatgtcttccactaacaaattttttaccgaaattattattattatcatttgtttgttgtagtagtagtgtatatgtactagtatattggtgtattgtattgcattattatattagtattattaataaagttgttgactctgtcactttctcggcaggtctttgacaaagacttgtaaacctgggtcctaggtttttttgttttttctttccaccgataaaagattactattaaagttccaagatggactactagtgcaacttgcaaaatttacacatatatttccgaggcataatatataaatatattttttaatttggcttcaaattatattcatattgttcaactttgaatgtgtacaaatagatacttaaatttgtataaaattgaataaatagacacacatgtcctacatgtcattttttgtcctacgtagtgtcttacatgtattatgtcatgtaggacgactcatgtgttaatttatttaaaagttggatagataaagtatctgtttgtgcgttataaaaattgaaggtcataagttaaaatttgaaatcatgtttaagagtttaggatccaatagatatattatgtcttatttatatatatgaggtctttttccatatatatatatatatatatatatatatatatatatatatatatatatgttgaaatagtgaattgttctgtcgttaggcaaacaatgcaatatgtggtgcatctttcatgcatgacgttccctagctactatgtcaatgtaaacactaagtcggctactccgccacaaaacgacttatt

SEQ ID NO: 299 - DNA, 22649 bp, Solanum lycopersicum
gatcagaaaagaaaaagaaacaaaaaaaaagaagaaaaaactatcctaattttattcacaatcaatcaatacactaagaagattcttgatttgtgaattgctctatgtttcatttaggagatgaagtcgatcttgtggctcttcgaatttgaaacgaatctacaacaaagacattgtcaacaatttctgttgcaagtattaacgtacacatctagttgttgctttgccattaaaaatccttcaaaaatgaataaaaaccggtgaattatttttcaacaaaaactcattttcccaagaaaagacactcaattttgagtgagatacataacacgtccatattaagaaaatgtgtttggtatgcatattatgtacattatatggtgtttaataagtcgacttttattaagtatatgaatattttgaggttcttaataagtcgatttattatttagtatatgagtattttaagttgtttaatagtcaatttattattaagtatttgttttttttttgcaaagtataaaaggttgtcttataagtgtattatgtgagaaaagtattaaagggtcatttggtagagtgtattaagaaaataatgcatgcgtcattcttgtttattagtagtaccttgtttgatattctttcccaatctatgtattcataatacttgttttagttatacaatctattgtttattaatgtgtgtattgttagtatcatgaatttctagatattagtaatgcaatggtttaaatgcatgcataaacttaattaaagattcaattgcccctcaatatcttttttttaaaagaatcttttccatcacaatagtgaaagatatctttataaacaattttttttaatgtaatgcattttaatttttaatatatcaaattaaacaatgcataaaaataatctatgtataattgatgcaagcaaaatctaatatataccccaaccccaaaatgatctttgcaatggaagacgttatttgttcccttgttatgaataagtaaagtttcttatcttccaatcaaaattccccaaaccaaaaagtgattcgtggaaagtagatgtgtagtattaatttttggtagtggaatttatccactcaaacttttggcctttcccgagtgttaccgaacaacataccttagcagcacgcttccatctattcatacaccctttgtgcttgttgcccccatttctgccgctccaaatggtgcctgctcaatctttgccaccacacccagctcttccctcttagactttatcgatcctaattgagccctccttttttcaatcaattatctaatttagtcctactgcgattttgtatgattcacaattttaatgctgctgaaagcaattatataaaagctgaaacattttgcactgatgttcaaaactaacaatgttaccgccaggctttttgagcgccagatttgcacccctgctcctggcaccagcgtatttttcatcttctcttcttttcgtcgctcttgttttatttatctttactgtgaacttcattcaacagctcaaccctttatgttgtcactttttcttatgaaataatttaatacttatgctcttggtttttaattcaactgccaagttgcaattgtcaagactaaattccgattttgttaaccttttcaatagtgggtgattttgtctccgcaaaccctgtgcttgtattattaccttaaattgggaaaatttctttttctgccataggggagaaagtcattcccctttcttatgggcaggggaccacatggagatgtatagattctccagcaccatagtctcatactctgatgtatttataatgtcattaatattatgatatactttttagcgagcagctatggctacaaagttgttgggtgcattagctgaaagcaagaggaagtctcacaaacattttaaggagggatcaataccaaacttttccatttaaattcatctcaggccgacattaataatacgtagtagcagttttatgtatcctgaacatgcattaaaaaaatctctaatagaattatagaactcctagaaagcatatgacctaagtatatgcataaactagactaaaacatataattaaaaaaactatactgtagtcccagataagttgaagtcgactagttggatcctcaataccataaatgatctgtttgggttccataatatttcattacttcgtacatagggactaatgcatattcccaactaattgaaatcacatatatagattttattccttcatgaagcctatctttcgctaaatcttcatggactaagcgattgcaggtctttctagaaattcttttcatatgaatttaggtctacctcatcccagtttaacacatttaactcatcatgatttcacaccgatacactggtgcatttgaggtcgaagcaagcgtgaacaaatgtccaagtcatctcaatggaccttatctcattttatctttaatgtttactacttgctcctccttgcaacgtggtccattttaattttgtttgatcatgtatgaccgcatgtccatcctaatctccgcaaccctcatcttatggatgtgttgaaccctttagcagctcaacctccatctcatataacatttatgatcttataactgttctattatacttacttttcgctttggtaggcatccttgtatcccttacacccataaacactttcccatcaaccatccgattttgatttcatttcaacattccaaccactaattgttaaacttcgcgaactgccaattgagctacaaagcctaatcaagatgtttttctttttttgcttttttttttgtattatccataatatctcacaccaaatttggctgccatgtttcctttgttctttccttcttattcatgctgattctttttttcgctttcctttgttccttttactttttttcccctttcttttgctcattatgtaccatccactgaactccttcttagtgtgaatagcaaacttacaaagccgggttcttttttttttttaaaaggagaaaaggcaacaatcttccatggttagtatggttttttctctctgctgcagctgcaaccacagtttgcttttttttttttcacacatgacttccaagtctgggtctttcttcactgcttattggcaaaattcatcctcctttatggtcaaactattacttcatatcacttatttcaatcaactcgtagagattgttgtcaaacttcggagatacaaaaatatggtgaaaatgttgtcatcaaactttgtgcaacatgttgcattgatactatatgtctccaattcttataggcaaataacatgatccaaaagataatttctaaggtacaacattttccaaaagaatcaattttctccataccaaatagatctgtctttttcttcggattgtccatggtataattgatcagagttggcatctttgatgcatacaatggttgcctaagaatgctggtgcaccctttgcagatccatcgtgccagaagattttatgagaacgttgtaccaagttataccatatacgatgttgaatgtcccgaccattcatttcgcaagttcacggatgacggtctatattttgtaagtttcagccgaaaccatcaggatctggttgtttatagaccaacatggctgacattttcctgcaaagaagaagattgtgatactcatgatcttcctttgaaagctagaaagtttgagagcttcttcacacagttgtacagtgttactcttgcttctagtggggaacttatatgcaaagatttctttctctatatggagagcaaccaatttggactctttgcaacttcaactgcacaaattcatgatgcacctcctactggaggggcaattcagggagtcccttcagttgaaaaaataactttccaccttttgaggtgtgtgatcagtctcaactattaatttcgtgagcacttaacatgatgttttggtctctgaagttatcttggttgcttttgttgtggttggtttcattaacttaggttggtggatggagctatacttgacgaaagggttttccacaatgattatgttaatttggcacatagcattggtgctttcttgtatgatgatttgcttgctatagtgtctcttcgttatcaaagaatacacatccttcagatcagagattctggagatcttgttgatgtacgagcaattggggaattctgccgtgaagatgatgaactttttctcaattccaattcccaggtaactatgagtgctctatgagggagtgggggttcaatttcatcccattctcattctttttttttcaagagaggtaaggttgtctaaatgaagcacaaggttgtgctagaaattacataaaattcagttccttatcaattactgtagttttctgagaaaatctgtcatcctatcaactgtattaacattttctagtctacaaaacccaaaaagaaaatacatctacactttagagtatgaatgttttaatatttgctttcagaacatcatttctttgacttaaaagtaccaggatttattcagcgtgaaactgaagtgaattagagaaaagttccttttcatattactttcctgatatgaaagagtggaacacctattagtgagccagtttaagagaaatggaaggaactccactaaagttatagttcaccgaaggactaaccaaaaggccattgtgttttctttccctcttttttgtttaaatgttcacagctttggtatatcctagaaattgaacttccattgtctctccacagtgattcccaccaatatatctgtcttgtcattacttataaaaaaaaagatatctatcttgtgattacatcaaagtggtctgaaagatcttgtttgttgttctttaaagcttttgagcgttcctttttaggcaacctaaatccaaacattactcaccatgtggaaagaattctgaaggatgtatatttgattttggccatttctttcttcatattttattttattttgggttggggtaggtgagcaggagggtggaaattttgtatctctcttatctgaaatttgacaagggtgttgtgcataataatctcttacagtagcctatttcatcaggtgcttgtaaatcatgttggaaatggttttcatcatagtctgcctcaatcagaaacttctttcctgagcggtataaagcaacggctgctttcatatatatttcgaggtatatggaatgaagctgaccaaaccatggttagtaagagaatattgatttccgtatgtgctaagagtgttagtatgttgattgcttgattgctatgtaatttattatgtcatcaaagctgcaaatcattagattattctgatttaagcttgatgttattttacttatctatcttttactgattttgacctcatacaaatggaggctcactacttttggttttatattttctttttggggatgtttctcttttgtggatgaaatttatttggtagttctgattaactggaatcatattataattgtaatcatcacttgtttcgaattttacagtatctaattgctaaaaatagaatatcagattgaaaagctcatttcagaggagaacaatgtttctaaagtagaattggactgctaaataggaatgagttctttatttgatgcctctaacctaaaatgcaattcatctaggatattgtttgaaaaaaaacctgctagaaaatgcaattcatcaagcataactctttctgaatcacgtatcttatctattttgtggaacctcgatcaataggagattgttttctcatgttataatttatgaaaaccattgtgaaatggacgtcttagtgctctatcatgttataatagtttaagaagatcatgtgacatgagtgttttatttgtggagagcaagaagaaactgccaatcatcttttcatgtacagcaaaatgaaaagtgaagttgctatacacgtttttgtgtttcggatggaacgagtaatcctgggttcaattgctattatctgtatgggggatgatttagtttatgaggtagtaaaaagactgtgacagcccagagccaactggaaaggtattaccagtacgtcacgacttttgggcctagtctccttggtctttaacccaaaaggcaccttgacagttgaatcctgaactcacccctctatggtccccaacttttccctgctattccaatgtggaattagctcaaggtaagcttcacaatgaacccaccttggatttcaatcgcttgcggttcgtggctgttacacttaaccccccttaggttctcatactacttgtagcggtccaagcctaactgtctagtattcttcgctgcggctcaaattttgtgcctcacagtagtgtccctttcaattttaacccaaaagacacctcaagagttgaattcctggttccaccacgtatggtcctaaactttcccctcctatttcgatatcggattttcccaaggggcacttcaatcctcaactggtagcggttcttgtgccatcacactaaaatgttgcaccctgtaaatattggataacttttgacacaatttaatgctttgtagttcagttttattaggttaagctgttggggataatggagttgttgtaactgatgttgaaataatgtgatgtctatctagaacttagttaaagttggttggaatgaacctttgagttatttacctcaagtgtagtcctttcattttatacaatttgagaaatgtaaatagggagctagtgtgttgactttacacaacagttaatcatactttgtctttttatgaccccaaacatttatctcccatgctaacgaggggatttgcagaagcatgcttccctagatactgtcttttagttcagcactagtggtgttcatgtgttgataactcacccccttcgggtctcgcttaaggtttccccaccaccgtgctagggaaagtgttaattatgacgccacatgtagcggccaggcgcaatttccaaaatattgtttgctcttgcccatcctctttactcaaaaaggaattctactttaatttaaaaattagaatactaacaaaattatactaatgaactttttttagatagtatgaaaaattgtatggaatcacatgaagtaaaggttgagaatgagaaggaaatggaatataaataatataaaataaaaaacataaatttctagaaaacattataattataaagatttataaggaatttaaaataataaaaataaaaaatacattgaaacgaaaaaatagaagtagaaataaaaggaataattaaaaagtaaacagtttgtaattacaccttgtaattatcagcaattcacagcctccccatgtgaattgaaaagtgtaattacggtggctttccgaacaggccttaatgtctctgatgtcatcttgtatcctccatgaattttagtatccttggttagacagttaatcagaagtaaagtcactctcgatttctgaatccatcaattcaaattttacacagaaaattgtatgatcattgtttctgtcattaggaaagtgataaagggaaaaagagaaaaaaaaattaaaagatatagggggaggaaaatgataacaaagacaaatttataagaccaaattatcatgctctagaattctcacgatgcaaaaaatcatccatgtcataaataatattcttcttccaaaacacttgccttttccctctcttcttgagtaaattgttttcagtacctatgaattatttggatcttttttttttgaagctggtaaggttgaattcttcagcattaagggtatgctggctacctccaaaaaggaataattacagatttccttctgtgaattatttgaatcaaaatttatcgagttactttttgtgtttttttaatcaaggtatgtataatggtgcggaaaaattgagaggaaaaggatcataattagttcagttgaatgtagaatgtatatatcgtagaaatcttataatcgaaccaataagctaaatttatcttatcatgcatttaaattaaatattgggaaatgggtcaatatgctcctgaaatgtttcgagatggagcaaattgggctggaccagatttgcctacgttaataattgggggtcaaatatgcccccccccccccttgttactaaaataggcaaaatttgcccttgttttctagttgcggaagtttagcacccgttgatgtcacatgtcccgcaatcaaaggattaacttttttaaatggagggtaaatttgaactttgcaaagttcaagggcaaatttgacccttctctctaatttctttatcctcccatctcgccactactacatcttgagaactataagttgcccattgaataattcataattttaccttgtttcttttctaggttaacatagcaataaaacttctatccatctaggatagtaaacagatctgatccatacactatcgaactcctttctaaggtagaaaagtttgtatgcaaagtttctacaaactttcaagtacaatcttatatgggtatatgggttaaatggacaatatcaacatgataacaatacttctacttctagggacaaaggtgatggttagaaacaaaggtgttacaagaatgataactgtcaattagaaagctaaattgtaagtcaggttgtgcacacttttaggactgcaagaaggttaaaacaatctcgtttcctgactctggtttctcttttttaatcagagagtgcagtgcctgaagaagaagttttacttccactttcaagattacattgacttgattatctggaaggtagcgctttaacttcagttttcatattttttatgacccagatgctctgccttccagaaaaactggacatattcagttgcatctggtacctactgtacatttccagggcgtgattcattttccgaatcattgaacatcttgctacttcttgactgcaatatgagcaggtgcagtttttggaccgacatcacctgttgatcaagtttggcagtgttgatggtggggtgagatttccttttttgctctatgatatttgtattgtggtctggtcatttattctactcgtccattatgtgattctggtgagttcacttgatatagaaacaataagtgtgatgtttgaatggtacccccaaaaaaaagaggaagaattgcggttcagagttgttcatatgatgattcttttttaaaaaaatgcacacataagcagtatccgacttcgttgttgcataactcttatcttaaaacgcatggcactaagtcattcaacttgtctcagtgggtatagcttgactagtagttatagagtcgctgcatgaaactctttcgttatttgctttattttgtagaacatacatattgctggtctggatcattatattttacctgtatgaaatcaattaatattattaaggtttagcatagatgagtttgtagttgaagcccctttttctcattcaataagaggagctacttttgagttcaactgtaactatatatataagatcatcttgccctctaaatttgtttagagtttctttttgatgcaagccaatataagttgtcacgacaacgtgttaccaaagttctaatccaattaatgttgcatagccgtatatagaatctgtttatttctgttattttggtggtctgatatctcttgtactatttagtttgaagcttttgcgctctatgggaatagcctgacacccatgcatgctgaatattgttgaatctgcaggtatcccgaaatgctgacatccatccttctttttttgctgtttacaatatggagactactgaaattgttgcattttatcaggtatatctgaggcttaatgcaagtgttgtacttcctgtcatgcaatgtctatcagcattaactgttttcgtatccttcagaactcagccgatgagctttatttcttgttcgagctgttcagcgaccattttcacgtttcatccaaaagttcattacatatgaacttcatgtcctcacactcaaacaacatccacgccctcgagcaactaaggtgtacaaagaacaaagcaaccaatttctctcaagtaatgttctcctctgagagtcttctagagcttctcccttagctgagctttgttctttcctttttgttttgtttttattttcttttagctttttctctaataatttggtttgggctcagggcttaaacaactcttctgctttttgtatttttctttaataaagggtttagacccactttgattaaaataaaataaaacgttctcctgaactgacgagttttgaagtgcttaagtagcattttttttgtttagcttattttataaaaaatatttttacagaaagtgataaaaaatatttttgaataacttcttcaattttcctaattttattttcaaccaaacactactggggaagagtttttaatttttattttatattctgatttcctaaattttatcgcacctgtttttgaaagaaacatgaccgaagttcttttgctgtatctcatttgtatttttttagtatgaggaatgcaatagcttttgtggtttgaaactgatgccatgttgtttccaaatgcagtttgttaagaaaatgatggcttccttgccttgtagttgtcagtctcagagtccttccccatattttgaccaatctctcttcaggtttgacgagaaggtctgcttctagaattcaatctatatttattatgcaaaagttatatagcaaatctataattggaactaaaatcatgacatagttcagttgaatctctgacgtaatgactagctgaatgaactgcatgaatgaaatccttacctctttttgtttggtttgggggtgtattctcgtgtttgaacttgttaggttgattgctgaaccttatattactttgatgcgttggcccttccccatatctggatcaatgggaagagtttgtggctaacagtctttgatagaaccaccaaggttctttttgatcaccatttctatgtcaacccctgatgcatgcagattttctgtttctcggaaggttatgcataatacataactaatgaactgtttatagtgcatcaattgcctgataatcataaaactatcttttccaggaaaaatatatcttttccttatgttcattttatagcagaaactcctgaatctagagcttatgatggtcttggcagttaaagtattagaaagacttcgtatgcatacgtgtgaaatgttccttgagtacctggaaattagctaagcatttatctttttcttagttcaagttagagacattcaaaatttaagactgagatgctactgggcaatttaaaagttctttattagttatcaacacttgttcttgaaaatgatagcaatcaccgccatgtgtgagggataaatggaattacattattcaaacaacttttatgatatgtgatgtgcatgtattgcatggtaaaagaatttcttttcttttctatgtattgaacttggtgaagtaagctactccaaagtggaggtataaagcagttctttagctaggcattgagcaaggttgtcgagtttaacctacaacattgtaacaatcccatcttgaatgtgttaacgagggatatattcattgatgggttaatttgggcataaccgaaattaacctgaccaagagtttggatcaggtaacccaaattagtccttcagaaaatcaggaaaagtttgtttttgtttgtatttttgggtttggcatggttggttgtttctctatacttccacataaggtggcaatttcagcccatataattgaaattaaaccattttgcccatattaaattaaattgattactcatagtttctttccttttcttaaagggttagtatggttttcaacctatttaagctcatacaaatatggactaagtcgattaacatgagaatcctgtatacccatatatcaatctcttataaaaaaaatccctaattgcactatttatttttgaaaataaaattttaaaaaatggggttggggttggggttagtggggcttggagcaaaaaaaaattgaaatttttatttaacctttttggatctgggtggaaggtgtcctagggtgggggtggtggcatttttttttttttaaagaaattgaactttttaaatttttctattaaaaatatgtttttaattctttttgtgggtgggggcagatgggggtgggggtgtagggattgcccatttctttttcaaaaacactaaatcaaattttaggttaagggctagagttttagggtaatatttttttttttggaaaaagtagaatttcttagttgaacaaatagatttttttctttttggaaattaagggtaggttggtgggatgagggcaatttttttttgtttttttatttttggaaaaacaaaaaaatgtaggggtcggttggtggaatggggggtaatttttttttagtttttggaaaacaaaaaaaaatgggtagattggtggaatgtggagaggggggttgggagtaattttttttttttttaaaaaacatttttttgtttttggaaaacaaaacaatttggggattagttggtggaggggcgagaggggggggggggagtggttggggattggaggatgcccggggggggggggggatttacctaaaccatatttgaccaaatccgtatttacccatatccaatttgggtagattgtaacccaaaccatttttgctcaatccgatccaatccaaccatttgccaccctacttccatatacgttctccgtgtaaagggaagaaaacaagctgtgctctttaagaaaattaagttttttgttttgtttggtcggtatatttatcttctccccccaaccctcccttaaattctctctacagttttacacacagcaatgtgtaagtaatagtcctctttggtttagtttggcaagtatttcttcacttttcatgcctctatataaaaaaaaaggaaaagaaaagaaaatgtttcttgtttggttgttgagtgaattctcactttatgcttataatgctttctcccttcgttggaaagtgcagctttttgcttcgtagcacctccaaacacacttccctatgaagagaattttctttagatttggtgggtatagttccctcttgaccctttaatttggttttgtatgaatttctcttcattattacccatttcctttatatagaaagaaacttttggttttggtgtttaatatgctcagtcaatttgatcattccctctagcaaggaaaaaaatctgtttattttatgaaggaaaaaaggccaaaagccctaaagtgctcaactatggaaaatagaacaatattgccctccatttgaatttgatccttactatgcccttgcccttatcattggtggactgactcagatttgctcctcaactattggaaaaagaactaatttgctgtccgtataaatttggtcctaaattgccctcattgcggatgaacttgctccaatttgcctatcaaaattaacagaccttaaatattttatttttaaaacagattatatttaagtccaagttaacaaaaaataatattatatttattaaaaaagagagtgctaccttgaaagataataatcttaatgcttaaatgttcttgtaaagacaattgctcaaagcaattatacaaaccgtaaaaacttgggatagatctaatttctcatcatgattctgtcttccccccattaaaaaaatctttaccctcatgatgtttaacaaattaaaatacaacacattcagcaaattggagatcttaaagagagaataaatagtcttcaatttctgaatatcgaattgaaaattctcaaagatgtgatatataacttaaagtaaatgaagaaatttgaagtacacttcacaaaagtttttgatcgtgctgaagaaattgcaattttgtcatgtcaaaaaagaaaaaaattggtaaatgtatcaattttatatttgttgaactaaatttgtgcgtatgatcgcaattgtgacacagaagtaatgatcttcaaagagacaattattagtcatcggttgagcaaaaaggaatgattagggaaatattgctcatcccttttttatgtgtatttcttaagaaaatataacttctacatattcttttttcttctcctcgactctttttcttcctcccgtcattctagaaaatagaagtcaaataaaccattgacttcaatgaaatggctgattgaaaaaatgtgaatcattagtttggagaggcaaattgagtgttttctttaacgttaaaagcatatttgtgttgacatactcactagtttgttagtttgttatcaattcttatcaagttatcaagttgttagagtagatttagattaagttgttaaagtaattccttagatttagtcaacttatttatatattaagttgttagaatagttcctaagaattagtcaagttagttacatcttacttgtatttaagttgatgctatgtttgaataaaagacattcaagtttgctttgattctcaatctctttatggtatcagagcccctctaaaactctgacgagttcgatccaatttttttcccctctctttgcgtccaaacatggttattcttgctaccaccactgaaagtgctgctgcagttccgactaccactcatgtggtacaatttaatccagctgcccaattaccgatcaaactcaaggtaacctcaatttcgcaacctggaaagcgaggtgatgctactcaatggacacaagctccttgggcatctcactggtaacaaatctgctttgccaaccactatcacacaaactgatagtaccatctccaattttgaatatgagttgtggttttgccaagaccaactaattcaataggcaatgatgacatccgttgaaaccaccattgctcccactattgcagcttccgcttccgcaaaaataacttgggatatccttcacacatcttttgccaataagagtcacactcgcatcttcagcttgcgaggtcagttgcaaaacatgaaaaaggcctccaagacggttgctacttacctataggagatcagatcgattgctgatgctctcagagtagtaggttctccggtggctgataatgagctagcagtaaagattgagtggcctaggtaatgagtaccatgaaatcactgttgctataagagcgcgcgacacaaccttaagctttgaggagctattccagaaaactcatggaccatgaactcttcctcaaacattaagacatttacaggtcatcctccatcatcgtggctgcagttgtacaaaagaccaacttccaaccccaacattagaagaataattgtcgcttcccaaatcagtcttcaagaccacaacccccacgacaggcggttcctcgaaatcaatagaatgggagactacccaggcaagcggtaaagtgccaactttgtcaaaagatcggtcccacagctgatgtgtgtcgctcaaaatcgcacaaccactttgaagctaaggtcaactttgtttcaaatcatcactcagatgcatctctttggatccttgactctggagcaacccatcatgtcaaaacagagtcaaataatcttgaagaataatccgacaatgaggaagtttccatgggtgatggtaaaactattcccattactcacactggtttaactcaacttaaggcttctaattccaattttgtgctctctaactctgtgctccagctataaaaaaaaaccttatatctgttgctatgttttgcactgacaatctgacctcaatcaaattttttccactcttgtgaaggatctcaaaactcggagattgctggtagaaggccagaataaacatggactctatgagtggcccagagggatcatgtgtcaccttccgccaacttcacctccaccaaagattcccctcaactctggcatcgtcgcttgggtcaccctcatctgaaaatcttagacttagtacttaataagttcacttccctttaccacaaaagaaaagtttcattttgtaattcgtgctcatcaaataaagctcatcatttgccatttcaacgactcacttaaaatagtaatgcaccacttcaaactttgtttagtgatttatggggtccatcactcatgttatccattgataaaaagttgtattactgcatttttgttgatcattacaccaaatatacttggttgtatacaatcaaaaataaaaatgaaatcgcttcaatttttgcaaactttcatgctttagtggaaaaaaattttaaacacaaaattgtctcactttatactgatggagggggtgaattcacaggtcttaaacaatacctacaatgccatggcattgaacatttgatctttccaccctacgcgccccaatgaaatagtcacattgtcaaaacggctcgaattcttctcaatgaagcctcactaccatctgaattgtggtcctttgcctgtcataatgcaatctatctcataaatagactccttatacctggcctgaataatgagcgacgacatagtcacattgtcaaaacggctcgaactcttctcaatgaagccgcactacaatctgaattttgttcctttgcctgtcatcatgcaatttatctcataaatagactccttacacctggcctgaataatgattctccgtataagaaattatttggcaaaccaccaaaatactcttcactgaaaatttttggttgtctttgttatccatggcttaagccatatacacaaaataagtttcagccttgtgtctaattaggattttttattgttcatcatgcacacctctgctttggtccagtgcactcaaaaattttcgtcagtcgtgatgttcattttgtgaagacatttttgctttcattcaaatgttctcacacttgcaaaataagttttccaagttacaatgggaaatcatagagtcccaagtttgtaaggatactcagccagcaatccaattaaatttggactccaatctagttccaactcttccacctcctattcctatcactcctattcctatcaccttaacagttccctctaattcaaacacaccagagtccagaattgaaaggcagtttaccaacaatgtccacttcatcagcaatgattcctatctctactcaacctccttcactacttaatgaagcagcccacaactctcacccattactcgattctcatcgtccatcacacaaccaacatccaccgaatccaccagcaattatgccccctctaccattcgatgttgtcacaaggtccaaaaataatatcttcacaccaaagaaaaaattcagcttcttggctcccctttctcccactccaaatacctttaagcaagctgttaagcacattgaatggaagagtgcaacggatatggactacaaagccttaatgagaaaccaaacttgggaactagtacctcggaacccgataaacaatgttgttgattgtaagtggttatttcgtattaaaaaaaaggctgatggttgtattgataggtacaaggcgtgattagtcgcaaaaggtttcacacaatgtccaggattggattttcatgaaactttcaatccggttgtcaaaccaaccaccatcagaattgtcctttctattgcaattcaaaataactgaaaagttcagcaacttgatgtgaataatgcatttttgcaaggtaacttataggagaaagtattcatggcacagctgaaaggctatgtcaaccctgattttccaaatcatgtctgtcgtctcaaaaagaccatttacggcatgaaacaagctcctcgtgcctaatatgaagctctcaaatctcacttgactacaattgggtttgttaattctgaatcagatgtttctctatttattttcacatccgaaactgtcatgatgtatattatagtgtatgttgataatatcatcattagtggaaattacccaaccttggtcacacatgtaaactctctgacaacttttccctaaagaaccttggtggactcaactattttttggggatcgaagttaaacatgttccaaataggattgtcttatcacaatccaaatacgtacttgagattctctcatatgcggatatgtacccatgtgctcaagctcaccacccaaagcaggcgatggttcacctactcccgaaacaaccttgtatcgacgactattggtaaattgcaatacttattattcacgcgccacacgccttgatattcctttgcagttaatcaactatcacaacttatgcaatctccaaatttggagcatttgaatgcagtaaaaatggtgctgcgatacctcaaggcatcatcaacgtcgtgtctgcaaatctctagccactctgatagtaatctgtatatttatgttgatgctaaatgggcaggtgatccttgtgacagaatctccacatttggttgcatactcttcttgggccaaattcgacctgttggtcctctaagaagcaacaatcagctgctcgttcctttactgaagcaaaatacaatcggtagccaatgcactctctgaacttacttgtaggttcttgattgaaatgcgatatcaagtcttgcaaacaccaagcattttttgtgataatattggcgtttcatatctcagcaaaacccccgtcttccacgctaagatgaagcacattgcagtagatttcactacctccgcaacagtgtaaacttaggtagagtaatagtcaaatatcttcctgcaggggatcaaattgcaaacattctcacaaagccgctgcccaagcccgccttccttcgatgtttattaagttaggcgttgttgcaccacacctaacttgagggtgtgtcttgacatactcactagtttgttagtttgttatcaattcttatcaagttgttagggtagatttagattaagtttttaaagtagatcgttagatttagtcaacttagttatatattaagttagaataattccttagaattagtcaagttagttatatcttacttgtatttgagttgatgctacgtttgaataaaagtcattcaagtttgctttgattctcaatctctttaatttgagaccaaatccaaatggagggtaaaattgttctatttatttagggcctatgaatagttggtaagcatgtttggtcctttttccttttatgaatattatcactatttccacatcgatgcatttttctccatcgtggaaaaaagagagttcttttttgtttagggggtatgcaacagactatggaagagacaaacaactgatgaaaggtttttgacttgattgcgctcagttacatcccatgataaccgtgcccttattgacccagtaaacattagtgagttgggtcattgatgcaaaggattgggtgtcgagccgagctttagcgagcccaatcgacctgatcagttgagcttagcctatgtgaactcttcaatgtttagttctatatactactatgtcattaaaaaatatttaatttataacaaattggttaatcaagaaaaataagtattaggggtcgtttgataggtgtacaagaatcgtgttgagtagagtatattagtaatgttggtattaatatgttgacattatgcggagattatttcttatgcacggtttggtttggtgtaaataacatgctttgcataatatctgaaaataattatttgtttacaaaaacaccctccacaaatgtgtgggaaggacgtgggaacactaagggcaattgtgtctttaaccatgctaatgcatgcactaaaaatcctcacattgctaataccattgttcgtcatctatcagttatacatagcatgataccaaaaagatgtacaaaaaaaagaaggtattagtaatgcataaaactaatgtcttattttttttttctaatgcatccttgcaaatgaccctgtagtataatttggttattgcattcaagtgtgattgaattatatgtataatttggttatcgcattcaagtgtgattgaattctatgtgttattagtttaagttagaccttaaatttaaatgaaggtaattttatattaaacatagaatagaatattcagaaaaaaataatataaaaatcacaatacattcaagaaatctgtacaatattaattttctttaatttttgagttcttgaacttaaaatatttaataacatttttcactacccataaaatatttttagtaatgatgtctaaaaaaataattacataaatttttttaaaggagtacaaaataaatttgttaatagtaaataataattattgaattaacatcttgctaacttgactaagattaatggattaatttttgttttaaagcatgatcaaaacaagccaaccaagccggctcaacctagtcctagttttaatagagactagcttaattttcaccaaaactaagctgaactaaatacaggcgagaaaagccgagtagtaacgtgccatttgataacatagtctgggttgagagagttatccttagtggatgaacatttcatcttatatctaacaataagccgaatcatctaggcttattttctgcaacagtggatgatatttggtcattttgagcaagttgataggagggtatttttgtttctttgcaaatttcagatctaactgcagatatattaatattgcaaccattttgagaataatttccaattagattactgttagtccttcatgtacaatcttgttttgtatcattctgatacttcagaattttttcagagcgtgcaatttctttgcagcaatttgttggatctactcagccctctcatccataccgcaatgtgtatttttttgcttaattgcaatatataagtgttaattctatatataagtttggaaattttcttgtgagcggtttaaattccttattagccttctattgcagcttatttcagctattgaccgccatagacagtctactgaccatccaatcaaattcatttctagaagacaacccaatatcctgaaattcaaaatgaagccaggtacggacttttttatttataattgttgacatgcttcatcttctggtggtaaaacttggcttgttttcttatgctgcttattattaaagtacatttactatcaggacctgaagctggcagcacagatgggcgaactaagaagatctgttccttcctcttccacccaatattaccccttgcactttctgttcaacaaaccttgtttctgcaggcatcagttgtaaatatccattttcgtcgataatgtaaaaacttaatttatatgttaccgatttgtttataaatttctctaataacctctagattgaaatcaacctagaaatcacaaattcatcataacagacccgtagatgctagtgtctttgacttctacattttctttgttacaagaatcaaacaaatgcttgatagagtgccaagacggttagtatgggtataaggattagttcttctgtaagtttttgttacagcttctcttctaattaattgatgtacattcagatgtttatttgtgaggtagaaaactgatgaagacccatttttggttatctatggatactgtagactatggtacacaaaatcttttacctgtatcagctgctttgggatgtttaagtcagaataaaggaagatgacatataactagattttccattcgttgtatttctaattctgtcagcattccttttggtttcaattagaaaagcaatatgatgatgcttgaacgaatttggatgaagcaagttcgtgaagaacttttggtatgaattaggagtgattaacagttaagttgaatataagtcgatcaaatgttaaataaaaatgggtcaaatgcagaacttgcttcatattttaaacgagtaaaaatgagttatccaagggataatattgataaacatggatatatattattatagtatagagattgtgctaaaagctaaaggcgaaatggttcttgtacttgtgtctgcttgtattatggacacatctacttaccctttttgtcatcctgacccttgaagccatcaaacccacattttaaacacaatttttgatgtggtatggtgcgtgttgcacaaactcatacacattgaccaaaagaaaaataaatacatgtatcaatattatattccacattggcaaatgactcatatgaactaagaattgtccaaaccttcacgaattctccacttctccccttctccccttctcctctccgcgatttctcacagttcgttgcgattttctcagttgaagctcagttctatcacaattttcttgtaagttcttgccttttatgttagttctgattttttttatattcttcatgcgtatctttttgattttagggtcgattttcattagattttctaattttttggggaattttactttggtttgggtgtaatattagtgtattatgctttcgtggtttatgtacgactttgagcgacttcaaggacatatttcgtgaattcgagtagattgtaagatttatttgtaaaatc

SEQ ID NO: 300 - DNA, 7670 bp, Solanum lycopersicum
acagttcatcattttttttattttttctttgtaatcaaattcaggtaagtgttcattcgatgaaaattcatgtttattattgcaataattatacaatgttctattggatttacaaattttgatttatgtgcgttcgttattgtggtgtcataatttatttatttttttgaaaaactggtttcaaaatatgattattttaagcagaaatttcgtactatacaattatatactttttgttgatgtagtatttgtatattataaagaagatcagtgtaagcgaatacaggtaatcgttggtgataattgtatataaccataaagtaagtgttttgcttttgatacaattatatacttttctttgatgtagtatttgtatattaaaaagaatatcagtgtaaaatcaattcagtaatttgattgtataatatatacaaaaacggacaattttaaaagaagtcatgtacagattaatttttgtatatatgtctacaaacttaccttttttttgtatattaatatgcttgtatatttataaatatttacaagcaagaaaaaatacatgtgttacttatattgaaagttaagggtatttgatttacgtctaatcataaattttaaatattttttattttattttaaaatttataaagttagatttgatgctgtaattgtcttcgattcaaattcaataaaagacaattttttatcgtatatcctaatcttggtcttgttgttggaaggtggttgattagaagaaagagttaagtgaaatcgttcgacatttcataacattagtcgagaaagttgatatccatgaaacacatcaaagtttagatcttagaaggcttaattgaaaccgatgaacatcccgtgaaattaagtgaaatgtaaaaaaatcgggtgatgtaacgtgaaatcaattgaaaataccgcgattatgagagaaagacaaaaatgcccttatagagataaaattgaattccacaccataccatttgctaattgtcacttcatccgtaaggagcaacatgtcgaccgcaaagataacaccgtcagctgcttcatttgcgacttctatcaaacaccttgcgggcattcaactacctcgatgccaaagcaccatttttacctccaattccacgaagttcagagcacccagaagaggttttactgtatcaatggcggcttcaatcgaaacccctcttgaagtatgcgtcaaacaatcaattacaactcctaacaagctcggtgactgtatgtctctccttttgaaagtttgcgcaattacttagcttttatgtcattgatatccttcttaatcctgatattcttggagttcatttgggattgtaaaggcagcgtaacatttcatgattatactaaaaagttagtgttttttaagaatatgaacaacttttcattaccaattccaccaagtttagagcacccagaggagctttcactgtatcagtggtttcagtcgacaccccatatgaagtttgtttcaaacaatcaattacaaccccaaataagctcggtgactgtatgttttctcttgagaattgcacatttcgtagctttatttcgttgatatctctataagtgctgacattcttggagttcatgtttgatgcatgttcattttgcactaaaatttagtgtttttatgagtatattttcgttccctagaaaaattttggtagtgatgaattttttgactacccttcataggttgtttggatggttgttgcatgttttataacacatcctactgaatacgatatttggattgatcatatcatttcccgtccttgcataatgtcacgtatcagtaatatgacgtgcaaacttacaaaattataacaaggtagagttattctaaaaaagtagtgcacagagtaaatgggattattaaataataagcaaaggcaaaatgagaaaaaaatatcaacgtaagaggtcataccgaatcagtcattacataaaatgagacttcataacgataaatttagtgatacaacgtagtatagttgaagtaacaatcaaaatgaatattatattaaagtaacaatacaacataatactataggtagcaacacactcaaacaattaggccatattacctaactagttggggttggttttgaattgtttgtatccatttcactttattcaaacgcgtattcagtgatctgtttccatttcgctttatactagtcattagcctacacaattctcctcctttatctgggtttgagaacggttatgctttgtgaagctcagcatagatggggttggacttgtgcaagtagagggaaattaaataggaacttcaaagttgcaatttttctgttagaatttctcttgccggtggcaaatgtagtacatgcagtgcttattggcgaattgtagtttgaacatgtccattaattaacctttttcttatagactagcctgttaaataataggtacaaattgttacactagtggcattagtaaaagaacaacattttaagttgagattttggtgtaacaatgctttcattttctcattcaggcccattcacccagagggttttgcttacgttggaggagaaacaccttccatatgacatgaagtttgttgacttgagtaacaagcctgactggttagtttgaatacccgttcgtctaagtctcttgttgccacaagtgatgatagattagttttattttcaagctgcaaattttggaagtaattgaaattcttttgataacaacttatctaggtttttgaagataagccctgaaggtaaagttcctcttattaagcttgacgagaaatgggtgccagattcagatgtcatctcacaggcactggaggagaagttccccaaacctccgctgacaactcctcctgagaaggcttccgtgtgggtttacctgttgctattattgacatacagttttctcattcaaaataggcatgcatggttatatataacttcttactgaaaagaattctacattttgattttgacaatcctttcagaaataagtcttttctgttcatttctagctgttatatgattatttcaatcaataacaggagttgaatgttctctgaatctttgatcagtctttcaaatcttttgaccccttgagtgacatagttgtgtttttgttccattatgtaccacactttttaaatgcattgatcttttttttttgaagaaaaaaagaactaggttgggcacttctagtagatatgaaagtagacttaagaaagaagaaggggactttgccttaccacttgttatatctgagggtttacaagataatttcttacagatgtgtgccaaacaaagctataccaaaaaggcaaaaaccaagtccttctatacatttaatttaatctttgaagttttcatagaacgagctatcctatcctttgggctttgttagctttcaagttacatataagttgtaattcagtcatagctgtcaaacaggcccttccttgctttgacttagagacatggcatccccttctcatcactcttgacagcagttttattgttcatccacagtcaaaagcattgttctgattacattgaattgttgtcctgaataaatagtaaaagctggttcacagtcgtaaggttgcaaaataacgtttttactgccactgttccagaccgagatgtatgtatctgtgattagctttcactttgtagccatagttaatgctgctaattcatattgtgtctgcctatgaaaaatctaattactaatcatttatagtgcacaactgtttctcattatcttttataatcttgtagcggatcaaagattttccccaagtttgttgctttcctgaaaagcaaagactccggtgatggaacagagcaggctttacttgatgagctgacagctttcaatgattaccttaaagaaaatgtaagtgcttgtttttcggtattaaccaaatttatttgcctttgccaagattcacaaattgatcactgcttgaatctgaggaaaatgtacattgtagtgataagcaaagaagtgttgtgaaacaatgtgtttgttgctttatgtgtgaagataagtggccaacattgaaatgagaaacggtcaattcttgaatctcactttgaggagttggattaaattattatatattggatgttaaattagttattttaattgaaacttgactatgatagtactaaattcaaatatgtatgggacttcaatttttttttgtagattacgtgcttcacttttatgaggcgcacacttaacttctcgcttttcacttcaagcctcatggatcttgtcactatgttatgttttttgcttctaaaacgctgctgctgaagttaaataaaagtggttttcacttttcttttagttgctatttgttgggttacatagctcgggcaaatcttggatctgcttcagcctagtttgaccgttgcaggaaatcaataaatcagcatgcttgaagaaattgggctgagacacacatttcatttttcttacctcaatttttttttctttcttttaatcttctccaaatcgaaaacaaagctagctagcatcaacgctgctagtatctctaatagtggtatttcaggaagaaaacaaggagaaagatcaaggatgaataaaagaggaatgtatagaggaggtagagcaactagtagatatactaggatctttgtaattagccttcctagtctcttttatttgcgtatttttgaaggtcaccagcatatcctttttttttatgacaagggaaatccgcaagcgttaccctttgggtgcgcacagggtaaaacccccgctcctatgcaatagcttgcaggtcacacaggagaggtagcctgcactaggcaagcctgggtcaccaacatattcttaatgctggggaatacaacattactaatttcaaataataataaaaaaacccaaattaagctcgagttgattgatacagtacttgttggtggccacgaccttcaactatacttgacattttgttttctccctttctgtgaaaggcaaaacatcttttattgaagcccttgttattgatgaaaaagagagtatctttatttaaaaatctgaataggagaaacaagtgtcttggtttgtggcaattgtgaatttgctgaattacacgaatgtgaaaatccacattatgcatatctttctcaaatagtttaattttagatttttttctattccagctttctggctactgttgacgaagttattctttgttttcaactgaagggtccatttatcaacggaaatgaggtatctgctgctgatttgtcgcttggaccaaagctatatcatttagaaatagctttggggaactataagaattggtctattccagattcactttcctacatgaaatcatacatgaaggtatccgaagcttatgcagttccttctttaggttaactttatttgtttattcattttttgttcttaatactattccgtgcatagagatccttgttcagttgatgcagcaattgcttgctatgtcagctttaggatccttaactttgcttcgtctcccagtaattgctaagtagtctccattacccatgaatgaagatgatcaatctatagatatttgcaatctcgactttgtttattcttttatctgtcagtctcaaaagttgagatttatggccttacctcagaattgttgtcatctccctttatatcctaagaattagtttcagtgtctcagttaatagatttaaaatacaaacaacaggcaattgtcatttgtagaaaattgacccctcaggttcagttttatgtagtttcattcatttttattggctaggaataatttcaagttctaaacttctgatatatttgtgcatgtgcaacattcattagatttagatgaggattttttgtcttattggagatcctaaaggcccacttaaacctaaaatttgctttggctttgactcggaagtatttggaggtgcatggagaaaaagaattaaggacaacagaatgtggatcagagataatatgctttctttacaccatttcttcttcctgtacctcctaaaattctcctcctcctcctccaaaccctaacagataaaaagatgaataaaagagaataaataaggaaagatcattgacgagtcaatggaattcttttttggtagataatagttatacatgcatttataggtctggtgagacagttgccaactagatagtttctaatacctgaatttattttgtgctcagagtatattctccagggaatcattcatcaacacgcgggcactaaaagaggatgtcattgagggttggcgaccaaaagtcatgggttagacaaactatatcatcttttgcatttctgaggattaggtttttgtcgcaaggtatagtaagctagcatttggaaggctgtaagacagttctttgccctgtatattgttattaaaacacatactcatccttgttagactgaatgatagcctgagttatatatgtaatacatacttcctaaggcttgtgcatatgcaaaaattcttactttttcagatcaggaatgttatagcagaacattaatgttaatcaattggtgtagaattcacgtttaatagtcgaactttagtcatgtgatgaatatatctgctagggatctaattagattagtagtttccagtgaaaacatgttcctctttatcaatagagagactgcgaacttgcaatcagttggaacttattccttgctgcatgaagtttgtttgccaagggtagttttgtgtactgcgataatttctatatcgattggggtgcagccctttgcatgaatgtgggatgcttcgtgcacctgactacccttttattttttacaactatagaaaagaatttagaacagattaagtagtgaaaacttcttgtgttttatttattttatatgttgtactcatagttcatgtgcaattctattgggctgaaatacttctgttacaagctttcgagctgatgatctgttattggaattgcatagatgtttgagaaaactggtgactaacatatgacaaacgatgcctacatgatccaacttgatgaacttaccctatttatatggcatgtttcatatctatacctgttaccataagaagaaatacgacacaaagatcagttccatcatacttacctttacttatacagacaattctttaaggtatatacagcgtcttcatcatgaactattcagcctatcaattctgtcgatttgcaatataactagcaatatgataaagaggtgctgcctttgcatagtcgaagtagcttagctcattcatggccttagccatcagctcaccggcatattgtcgagccttttctagccccatcaacttaggatatgtagccttatctgttattaggtccttacccgctgtctttcccagctcatctgatgacttggtaacatcaagaatatcatctaccacttgaaataacagtccaatgcacctagcatagctcctcattcgctccacatcaacctcatttcctccccccattattgccccacaaaccacagcagcctccaaaagcttcgccgtcttatggtggtgaatgtactccagttcagttaggctaacttgttttccttc

SEQ ID NO: 301 - DNA, 3763 bp, Solanum lycopersicum; identical to SEQ ID NO: 223

SEQ ID NO: 302 - DNA, 12477 bp, Solanum lycopersicum
agtcattaaggagatatttatcatttgattgagacaagaaatgaacaattatgtaaatatttgaattttttactaattgagtctttttttccttttgtgttaaagactagttaattagaggattattggtttgtggcttaaccaagatttgaatctttatatataatggtgtatttatttaaattgatagctgagaacttgtttgatttgagtgtaatcttacttgttaaagatgttgaagaaactattaatgtaatatggatttatttttaagctatcgttatattcatatttattatatcatatcaccactaatcactttttatcattacaattattattatcattggtaactatttgttatcatcatcaataactattttcatcattacgatcattatgtaaaacaatattgaaactactcctgcgactcttttaaagagttcgaatcctatattaactaacaattctatggacaagggatgatttagttttaatatgattagatctcctaagtcatatataacttatactttattgttatatataaatgttgaaagctacatagataatacatcacttcgtacttttttttgaatcaatatcatagattgttaattattattatcaatcgttattatatctaccatctttatcattataattatgtaccattgtcactatcaataagatcagacattatctacctctattatcacgtgtaattaaataaattcgtaaaatattaatcgaagtcaatcaaaaaataagttttgttaaacttataaataatttaatataactagtattgtcgataccacatctacaaggtaacctctttttcctttttaaaaaataaaacatttccatgtgaaaaaaagttattaaatttttaatgatatattaaattagacatgaaaaataattcaattatgtctgccattggagtccaattcagtcaacttgacaaaaaaaaaacccaactgtttgacccgtgaaattacaaattgggtcatttccttttctagccaactccattgtttcactttcccttttgatcatcatcaatcttcatcactttttttcgccccaattttttttttttttggccacgatgggatctcttctccggatgaatcgccttgtaagtctcataaaccctaactagttttttttagttttttttgctaattttgacttttaattgctgaaaaatagtcttattgaagtgtttttttaggtttacttgttgttaattagcttcacttgtgataatgtatttaaagttcgtgatgaatcgttttgaatgttgaatttcagctcatttttgtagattgttttgtttataataacgattgatttttggtgattaactagctgaaattgattaatttacaataaactaaactgaataaattgaagtttccaggcagtaactgaggtttggtttttcatggagcaaggttattagtttttggatagtggggtttggaatgattaatgtataaatgaactgaaattgcaaccaattaatgatttttagagtttatttgcttttgttgtgatgatgtcttcatgattatgatcattctttttttggaatatgttcttatgggttgagtttgtgggatgaatgtaaagttcaactcatttgcgcatgttctttttatttatccccgtaagactgatttcggtgtttaactagctcagattagttagtctacaactacatgccaagtgtaatccgacaaaatgggatctagggaagtaagagtgtaagcagaccttatcagttatccctaccttaccacaaatgagatttgggataagatgtgtatccgtcatctctagtggttcactatctgaggaataattcatggaagaagcctatagtaaacacattcgctaaacatatctcaaggtggtatgaaagaagaaataaatgaagattaaaggcatgtgagagtgataaaaacaaaccaaaagttgttaatggggaagagttcaaattgagaaataatttcatgtgttaagtatgcacaagaaaaatatgtcacatgcggtgaaaactttgcactaaccgcatgtgccacagttttcccaagttaagagaatctaatactagtaaaatataactcaaacaaattcaaaccatcaaaaaatggggaagtgaacatttaaacgaataatatcgaggatgttacatactaataaaatgagcataatatttggatgatgaataatatctttgaagtgctgaataatgattgtatgactatcactctggggaaacaaattattctgaaatgctttgtcactgaaagtgaatatgacgtcattgaaatttggaggatctaagtagattcatgctttcttacatcatatgttcttttctattgtaatgttggtttctatagcatcattatattgctcaaatttatttcacagttctaaccacataacctattttcagaatttgtatttgttttgtcccacaaaataatgaacattaagaccaagcatgtgcatgtcatacgttcggtaacgtgtacattttgccttttttttcctttttaaagaggtcatgggcttcgtcattattaatacaaaatggacaaagacacgtgaatgatatgctctagtaaatatgctcctcattaaccataggcagctctagtaacagtagatgtttagaagaaggaacacatcaaaccaagatatcaagaagaaaaaagtgaccaaatccgtccctaaatattttctttctttattgtctatatatgtatatattttatgacatccaataataataaatgttagcgtagatggtcaagacctcataatttatttttgatgaagagacctcataatttattttgtgaacacgattcatacgttctagtgtatttagccattggttgatgcataagacaaaaattcttgttgtttgtcgttcaccacatgtgaaaatcaaattatagataatgaaaatcagattatagatgactattgaacagatgaagaactacaaaatagatgtaaatatgattcttttacttatcctccgtagatgccataaaaatcaagtactcagttcaagtttttaaaataaatcattagaagtaggaaaacattagctagacttaacagtttaaatttttgcttcttcttgaaggacttagtgtggggcttccatcgttttttgtgagaaatctcctgaaaatgaaggtgaaattggcattgttaataataccatgtttaggataatgtaaggtggcaactattcattgggagaaattattgtcaaagcggtttcttttcttccgttggctgcattaggtgtcttttgaagtaggttataggtgtcttttgaagtaggttatttaggttagggatatttaggtaataacttttaagtttttgagttcatgctttcagtataatatagatcggtctctaaccatatttttacttgtgatcaagccatagataccggtaagaagagaaatagatgataaaaatgataattataatttttttttgtataacaagctgttcgttttctatttaattcatagaaaatatatgttcttgggagtccctgatggttaaatacaacaagattcaccatgactgctactttagagaaacacttgagtgaaagcctataaaattgcatctgtaactggatacctacattgaaaaccatcgttcacgcttcgattttgatcattttggactagcagcactatccttgtatactagacaggctactgtgatcatattctctctgctatgatcaataatgggctcagaaagcagctctaatattaattgcaataaactaaacttgcaatctatagagagaaaaggaaaagttcatttaattggtaaaattgtgtaaagctctcagtacaataattcaaaagggagatgatacaagagaaagggattaagaggcaactccatcaactgagttttgtttacccaatgattgatttcatgccagaatgaatcgaggaaacaaggatgtctataatgtcaacaatccctccactcctgcaggaaggtgaaaggagagaaactgggagaggaagaaaagaggaactttaccactcctctgttctaatctatgtgaaggtgtttgactgtgctcgacgtttaagaatgaaaggaagacttttgagacttgttgttcaaagtaagccattgttaagggtaaaatgtgaaatttaaagtttaattgttactaaatatagaaatatgtctctttttggggcttattttaaaggaaagagtgtcacattaattgggacaaagggatgcattttctgtccaaaattaagatgtatatacttagatgcaagtggcaccatagatctggtactaccaaaaggtatccaattaatccatgcttggcctcccattacaatgcctgtaagaaataattgttctttccacctccacaactaattgtcgaactattatatctatctttattcccttaaatgtgaaacgaattacacagactatttggcgctacttttttcctagatatattgaagacctagtttcttatatttgtgggaagcatttggaattttctataagaactatatcatgttcgaaaacattcttataattttcgacaagattgctgaaggagtgtcttatcttttatgtattcttgactagaggagtttaataaaaagaaaatagaaaggaacaaagaaacgtacaagtgtataaaaggagttggggcaaagacatcagaaacatttagacctacgatttcatcctacatgttatggttttagttcgttagaggttttaacatattaaatcagcaaagttgtgacatacataaagtgcataacataaagatgaaattcacaatttgctgatcttttggtgcaagggaactattttttacactataagttagctgttaatttcaatattggcttcttctacaccttgttgttcttgagtataattctattttcacaaacatatgtcagaacttatgctgcaattaaatatattcaggttgtttaactcttgtacagcttgttattcttctgaggcatatttccttctccttatttgctaacttgtgctgcagttatcttccatcgtggagtcatgtaactgcatcattgacccacagttgcctgctgacgacttgctaatgaagtatcagtacatttctgattttttcatagcacttgcttatttctccattccagtggagttgatatacttcgttaagaagtctgctgtctttccatatagatgggttcttgtgcagttcggtgctttcatagttctttgtggagcaacccatcttatcaacttatggacatttaatatgcatacaaggaatgtggcaatagtaatgactactgcaaaggccttgactgcactggtgtcatgtataactgctctcatgcttgtccacatcattcctgatttattaagtgtcaaaactagagaactgttcttgaaaaagaaagctgcacagcttgaccgtgaaatgggtattattcggactcaggaggagacaggtagacatgttagaatgctaactcatgaaatccgaagcactcttgatagacatactattttaaagactacacttgttgagctaggaagaacattggcattggaagagtgtgcattatggatgccaacacgtactggactagagcttcagctttcttacactttacgacaccaaaatccagttggattaactgtacccattcaacttcctgtaatcaatcaagttttcggtacaaatcatgtcgtgaaaatatcaccaaattctcctgtcgcaagacttcgacctgctgggaaatacatgcctggtgaggtggttgctgtcagggttccacttctgcatctgtcgaactttcagattaatgattggcctgaactttcaacaaagcgctatgctttaatggttctgatgcttccttcagacagtgcaagacaatggcatgttcatgagctggagcttgttgaagtggtagctgatcaggtttgatttttgttattgaaaattccttaatataatgttaaaatttctcttttatatatttttgggttgaacacaaccacgttgacatactgagttctgggtgtaaaattagacatggagaagaccaattacaaaaatctgagaatctgctagcagaatcacaaggcttagttgttcttagtattatggttttatccattggaattgcacagcagaattgttattactgttatttttttttaaaattttcaaagataaatcaaaagctgaactatatgatctttttgcatacttcgtctgctgattgctttttggtgatggaatagttaggctgggttgtggatgagtatatcatagtagattttctgataggatcttaactccttggcttttgttttctatagatgatcccttgtattagaagcacgggaaataggatcgatggtatatagaaatattaggaacagcttttctgaatcatttgaatattccttttatggaacatagaacttcttgcagtgtatgtagttttcttagtacttttatcatatgaagtgaaaataacgttttgcgataatgtatttgagtgtgtaaaattaaatactactgagttttacaaaaataattcttcaacggaagccatttattttttttacatatctggcatcttacttctccatcaaagactttagagaactttaactttttcattctgtctctcgtagtgtactgttctctgatgtatgtaattagctcactggcaagtagcacacctagtctttgtttgacttgtttaaaaatcatgatgtatcatcagttacggtgaagtgtccaagttttactgctttttgctatttgcattgcagagtcttaaaacatttcagttattcctggatttctcctgtttatcaatggaaaattcaacttaatcaactatgcctcaatcaataaatgaaacctctatatctaaccactccaactcagatccagaaatcagatttcaaagaaattcatcataactcaactataggattgctgttaaccaagagtaatcctcatttgtccagacaggcgaccagctattatgctttcattatgggaaaaattgacaattaattaaaggaaggaacaactgaagaaaagacatccttgtcagcttcctctccccaacccttgcctgaataagacaaaaagtttcttggagaaaactctgaatattggtatccacctcctttctcctaatttaggatgctctatttctagacatataggggaatactctattctagtggtcggtgtctggttgcaactagttttagatgtttatatgtcttatttgatttaataagagctatccttgagtgcccaatgtgatttaatctacgcttcggcatttcaggttgctgttgctctttcacatgctgctatattagaagaatcaatgagggctagggatcttcttatggagcagaatgtggctcttgatctggcaagaagagaagcagaaatggctgttcgtgcacgtaatgatttcttggctgttatgaatcatgaaatgagaactcccatgcatgcaataattgcactttcttccttactacaagaaactgatctaactccagagcaacgtctgatggttgaaacaatcctcaaaagcagcaaccttttagcaacgctcatcaacgatgtcttggatctttcaaggctagaggatggaagtcttcaacttgatattggcactttcaatctccatgctttatttagagaggtgcccttcatcaccctcttttcttttttacttgcaaattctagattacctgtcaggaaaaaaagtgtcattacagatattttgcacttcaatatgtttgctggacctgctgactgatatatgtgtctgcttattcctgtaggtccatagcttaatcaagcctattgcatctgtgaaaaagctgttcgtcacacttagtttgtcgtcagatttgccggaatatgtaattggggatgaaaaacggttaatgcaaattctcttaaacgttgttggcaatgctgtaaagttctcaaaggaaggcaacgtatcaatctccgcttttgttgcaaaatcagactctttaagagatcctagagcccctgaattttttgctgtgcctagtgaaaatcacttctatttacgggtgcaggtatatttttacaagcttgatatactatcttcgtaggttaaggatagtcacaaatatgatattttagacttataactgtcagatgttctgttcttgatatttgtaatattctaagtaatactttctgtagataaaagatacggggataggaattacaccacaggatattcccaacctgtttagcaagtttacacaaagccaagcgctagcaactacaaattctggtggcactgggcttggtcttgcaatttgtaagaggtacggggtacccagttccttagtgttctttttccgactctgattttcattttgctacgtgaacttggtaactgcttcatattcaatttctttcctcttactgtatttagtattgacacatcttctgatgggacacaaaacaggtttgtgaatcttatggaaggacatatttggattgaaagtgaaggtcttggcaaggggtctactgctatatttatcattaaacttggcattcctggacgtgcaaatgaatctaagctcccctttgtgaccaaattgccagcaaatcacacgcagatgagttttcaaggattaaaggttttggtgatggatgagaatgggtgagtactatctggacccctttatcctcagctcttgtcttgccatgctgtttaatgatccatctagttcgtgagtttctcatcttatatgtattgagctgtcttactcacttttacatgagactgaacaagtaaatacttaataagagagtactgaaattagaatctttacaactatatgtggatgtgctggtgacatgtacttaggagtatatgcctttttctagggctaacccatcggtggccccctaaagttggcatcaactttcacttagacacctgaactagactttgttcatttttgacatctcatgtgaggctctgatgtatcatttaacactttttgctttttgctgatatggcatagtgagtgtgactcactcattaacagcgcgtcagactctttttcagccaatttttattttatatttccttcttcttccccattttttcaaccaccattttctcaagtttgaacttcttccatggtgagatatattcgatgatgccacaaacgaggaatctaatttcaaatgtcagagctttctccaagatttcccaaggatgatgcccttcttcctcaatttaatttgagggaaaaagactgaaatttgaagaaaaaaaaagaaatttggggaagaataaaaaatcattaaaaaatgagataatctccttaaaagaaacttaataatgtgatatgaacacgtacacatttgtatttttagaagttcattggatcttagattttttcttttttaagcaataaaatctgtagaattttcttttagcaataaaatttgcggagctgcaattatttgaaaaaatttgagttacacaagttcactgaaggggtgtgtgcagtgagaagaccatgaatggggtggggttggggtgggatatgcttctcctaaagattttttaaggtgatttaatcctttttaatattatttgggaagaaatgccacgtgtcatcgatccattagccaatttttctaaaaaaataatagatagtttattattttgaagagaacgacaagtgtcctcatttaatttgacactttacacatcatccgcgagtggaacacactcaccatcatatttttgttgaatgtaaaaaaagtgctaaatgacgcatcagggcctcacatgaggtgtctaaaatgaacaaagtctagttcaggtgtctaagtgaaagttaatgccaactttagggggccaccgttgggttagctgctttttctaatgaaaagaaggaaaagttaaggatttacagtgtcaggatcgcgagaagggaaggagagatcaccagcctgaccctaggagctcacatctttatcagagtatatgccttttttctaatgaaaagaaggaaaagtttagcatttacggtatcaggatcgcgaagagggaaggagagatgaccagcctgactgtaggagctcacatcattatctctaattggaagaaggaagtgaccaactggaagtagtgctttcaaatccaataaaagggtatactgctcttccagaaataagaggatggaggaaagagtgacttcatagatgtcttaatacaagtctttgctatgtatgcatcgaattaaaaatgtcagtcaatctggttcgccttagtatatatatatatatatatatatatatatatatatatatataacagtaacagattcccttttctcttatccttttatcgtcccaccgcacccctgccttccacaccgctattgatatctttaacctgaggtattataaattgaacgcagttgttttattgtcggataagaatttgtatgattggtaatcctacgactctgtgatcgttgcttttctctttttgatgtgacctcattattattatttttattatttatcctacctgattatatgattagttgacattagttatcagaattgtttttgtttcttatactccttcatgcagtgttagcaggatggtaaccaaaggtctgcttacacaccttggatgtgatgtaactactgttggctcacgcgatgagtgcttgagagttgttacacatgaacacaaggtagttatcatggatgtcagcatgcaaggtatagactgttacgaagttgctgtagtgatacatgaaaggtttgggaaacgtcacggtaggccacttattgtggcattaacggggaacacagacagagttacgaaagaaaactgcatgagagttggtatggatggagttatcctaaaacctgtgtcagtgtataaaatgagaagtgttttatctgagctcttagaacatggagttgtacttgaatcttagtgaatgtaggaggaaaatatgcagcaaccatatgaaaaattcacccaaatgcacgaggcgttgtatatagttctcgtctttggatttcttggtggataacacaatatatcacttgaagaaggtgtatgtaacgcgacgttgctcgaggcattcaacaaatttgtagaaaggagttgatttttccactaccagaagtgttcatattccatggaactttgtataagatactgatatttgacacaacccttcatttacttgaaacattagaaactttattgccttggcttgacacaacaatagattattatgtgtttttttttaattgccttttcatattcatagtattttctgaccttactgtataacaaagagtttgaactgaaggggtgttttgactctatgcatcacagaagcaaacagcaaataacaaaactaactggtctttcaaaagggggagggtttctctagttgaaagttatcaaaatatattctttttgggattaaggcagacttatatatttttaatcattattataaatgatggaaatgggaacgcggaacgaggagtggattacaagatggagtattaaattgggcaatttttacatatagcaaataaaaaattcatatttgtatgctatagtaaagtttgcataattgcgctccgtagcaaacatggaaactgaataattcgctatacatatacagttgaagcaaattgtataaaacgaagtgtataaaacaagaaaaagaaagacatttgggcagagaactgtataaaaacgaagtgtataaaacgaattgtattattataagtgtatagaacgattatatacaatttgaatttgtataaaatgagaaagagagaaagacaaaagagacttgacaaaggaatatacaattgaatcgaattgtataaaatgagaaagagagaaattagatataatttgaaaattgtataaaacgaaaaagagagaaaggcaaaagaaactgggcaggggagtatttttattgtataattataagtgtataggacgaaaatatgtacttgcatgtctatatacaattttctcacgctctatacaaacagaaacgcaatttatacatttcgcttctgtttgtataagtgagaaaggcgagggtggcgagcgagatctggaagtggggaacaaaaatatatgtagttatacaattttctctgctttatacaattagaaacaatttttatacacttgtgtttgtataaaaagtgaggaagtgagcgagagattggaggagagtgacgagcgagatatttgggagagatgcgcctgacaattttttgcaagcgtttgctatggaaca

SEQ ID NO: 303 - DNA, 8414 bp, Solanum lycopersicum
tcgtgtaccctatttcaataataaaatttcatgtttgatttttcactttaatatctctactattttgaaaaaaaatatattattttttcatgttttactttcagcattagttatttatttcacagataatatttcaaaagttaatcctaagctagcgtttggtttcaagttttcaaatattttcggtaaatcatattttaggtgaagtttcaccttttgttggtcccaatttttctcaataatatttgactattttcaaaaaatatgactaatagccataagttctaaaaattatttaaaatattcataaatttatatcatcattttacaatgaatatgttctatataatcttataaattgataacaatataggaaaaacaacacattaatctcgcatactcagacttgtcactgcttcagttataattataacccattaagcgcaaattattcttttttctcaattttatcactcagttagaactcaaaccatttcggaagatttagttcaaatattagatagaattaataaaaaatatataaaaaattggagtagtttttgaattttctattcccaaattttaaaacttggctcaaatactagttttttctagtatttggaaacttgagatatttattaaatatatttgttaagttatattaccaaacactatttttcaagtattcttaaggccaaatggatcctaaacgttaattaaaaagatatatgtaaagtgttgtattaagtccaaatataataaataaaaataatataattttaataaataaaaataatattttaaatcaaattgcaagtgaaaatacaacaaacaaaattgattatatcatttgacactaaaatcaaacttggattattgagttattgttatgatgtcactcaattttactaaatttagcacttcaccgaatcaaaacggttggccattaatggaggatcactcttacttatgctttactgtattagtggtcatttatcctccacctctagctccggcgacctcgtcgcgtatctctttttccggcgatattcagttgtaagttcttctatcggtactctgtttcttatatcaaaacaaaccctaatcccttttctcgtaattttaatagaggaatacgaattgtgttcttatgatactctgtgtaatatagcgtgttagttacttcctccgtcctattttctatgatgtgatagatgtttgtgtgattataaattgttttattagggataaaatgagtgttttgaagttaaatttgttaattataaatgtgttaatttttttttgaaacgtactaaagtattaaattctcagtgttttgagactaacgaagtacattttatttgctgaattgttggttttcatctattgtgctgcagtggtgttgataagataagagtgattcattaaggagtttgttcatcatggattgtaactgcttcgatccactgttgcctgccgatgagttgttaatgaagtatcagtacatttctgattttttcattgcagttgcttatttttccatcccaatcgaactggtatactttgtccagaaatcagctgtttttccgtatcgatgggtgcttgtgcagtttggtgctttcatagttctttgtggagcaacacaccttatcaatttgtggacttctactcctcatacaaggactgtggcaatggtgatgactacggcgaagttctccactgctgcggtatcatgtgcaactgctgtcatgcttgtgcacattattccggatttattaagtgtcaaaactagggagctattcttgaaaaacaaagcggcggaacttgatcgtgaaatgggtcttattcggacacaggaggagacgggtagatatgttagaatgctaacacatgaaatcagaagtactctggatagacatactattttgaagactacacttgttgaacttggaagagcattgcaactggaagagtgtgctttgtggatgccgactcgaactggagtggagcttcaactttcttacactttacatcatcaaaatccagttggatttacagtacctatacaactccctgtaattaatcaagttttcagtgcaaattgtgctgttaaaatttcacctaattctgccgttgcaaggcttcgacctacccggaagtacattccaggtgaggtggttgctgttagggtcccacttttgcatctctcaaattttcagactaatgattggcccgaactctcgccgaagagctatgctttgatggttttgatgcttccttcaaatagtgcaagacaatggcatgtccatgaattggagcttgttgatgtggtagccgatcaggtttgattttttttatatgtgatacaatatctgatagcttcactttattaccacaatgagacaactacattgatgcagtttcatctgcactgattacaacaacactaacaatatacccagtgtgttcccacagagtgcggttgggggaggatagtgtacgatcttacctctactttataggtagaaagtctgtttccgatagaccctcggcttaagcaaaaacagtcaagaaaaagaaataacggaagtgaaagcatgacaaagatttctgaacagtgactatagcaaaataattcaataatcaaagtacaagaaacaatagatagtaatagtaattgacgtacaagaaatttcatctgcaccacgctgattatcttcatacatgttattcctcttgattcacaaagtttgataaatgcttggactgaattttcaatctgaggtgtatgaggcttttaagcaaaaagcacaagtatagtgtagacaataattaagaagtaaaaacactcaagaataaaaactattaacggaaaaagcaattatatgagtaaggaattggaaaaaatacaataaaaagcaattgtatgagtaagggattgaaacaaatacaaactaagtgcatatttacctccataaggtagtggtacggtttgcatacactctaccctcctttgaccccacttggtgggatttcactgggtatgttgttgttgtaagtgaaacatttattattttgtgtcgccttcttctaggaagagcttattggtgatgaaattcacactgtaactccttgttgcatatgcattgtttgatatatgcaagtcaaaacactcaacttgtttttcttaagccgagtgtctatcggaaacaacctctctatcccacaaaggtaggggaggggtaaggtctacatacaatgtacatctcaccttcccagaccctacttgtgggactatatcgggtatgttgttgttataacactcaacttactattaacattagcttttaaagatggcagttgactaaatctggcttccacgactgttatgctttatgagactttgacgttggatgtaggatctaaacaaaatgggacctacaattttgatttgatttcatatacatactgtagactaaagatctattatgactgtccgagtagtattttctgtactcttcatataaagtgaaaagaagggaaaagttaagaatgtccataaaagaaaagacagtattgtactgttgagatttcttcagaaggagttgttttctgaaggagcagccctccacccctcaaattttcgctggcgccccacttctcctagtatttgtggagtgattgcagtttcctcattgaagtagatagattcaagcttctagtagactatgattaatcaatcaactgggctcaaacggaagcagctcatgcatgtgggacttgaatgtgtgacctgatggagtgactttttcctatatctgttttcaatgcaggtagctgttgctctctcccatgctgccatcttggaggaatcaatgagggctcgagatcttcttattgagcagaatgtggctcttgatctggcaagaagagaagcagaaacagctgttcgtgcgcgtaatgatttcctgggtgttatgaatcatgaaatgagaactcccatgcatgcggtggttgcactttcatctttgctgcaagaaagtgaactgatacccgagcagcgtctgatggtggaaacaatcctaaagagcagcaaccttttagcaactctcattaatgatgtcttggatctttcaaggctagaggatggaagccttcaacttgatgttgggactttcaatcttcatgctctcttcagagaggtaagcctaattttcccttttacttgcaaattctagattatttgagtaaaagaacaattaaaatatgttctcattacttatgacaatattgggtttttttttatcatgttgtgttggaaactaggagtgacaaatgggcgggtcagtttggatatgagcgttggaaacatgctaaacaaaaatggataaaaatatattcaacctgcccatattttacgcggataaaaaatgggttaaccgatggataatatggataatttcaatattagcttggtgagaacacaagctaaaagtcaaaatgagcttagactcccaaaagtaagaactcatgaaatgtaaccagcagagaaatgggtattgctaatatggatactttccatatgtgatccatttttaaatgttcagttatccaactcatatatagtgggttggattggatggttacttgattttttaaaaccattttgccaacccttcctgaaactattcactgattcaggtttctgcttattgctttaggtccttaacttaatcaagcctgttgcagctgtaaagaagctgtttgtcacgcttagtttgtcttcggattttccggaagttgctattggagatgaaaaacggctcatgcaaattcttttaaatgttgttggcaatgctgtaaaattctcagaagaaggcagtgtgtcagtttctgcagttaatgcaaaatcagaatctctaatagatcctagagctccagagttttttcctgtgcagagtgagaatcacttctatttgcgtgtacaggtatgtttataggtttattttcatgcttgatatttagtgttcccagtaaatggtagttgctctgtaaattcttcttgggtagtgattgttattgttttttatttttattgctactttttctgtgtaatttaggtaaaagatacaggatcaggcattaatcctcaggatttccccaagttgttctgtaaatttgcgcaaaaccaggaaccagcaactaaaaattctgctggcactggacttggccttgcaatttgtaagaggtatctcacttcactggtttttgtattgaatgcagttttcggtttgctatgataattgaggactgcagattgagacattgagttctttttttttggctgatgcacattccctggaaatttagtaccatgggatgttgagacacttacaacagtgatcattttctgacgtattgttctcatggcctggatcaggtttgtaaatcttatggaaggacacatttggattgaaagtgaaggtgtcgggaagggttctactgctatctttattgttaaacttggcattcctggtcgcttaaatgagtcaaagcttccctttacggccggattgcctgcaaatcacatgcagatgacttttcaaggactaaaggtcttggttatggatgataatgggtgagtgctcatgctacctcgttatcttttgtccaatcttgttctgctatgtgttgatctgttttacgtgagactggacatttacaagttgaaaaaagtggtagtcattggacatcactttggaacaaggagcctgaccgtctattactgtctatggaagttaagagtccaataacttttatgtatagtgggatgttctagacttagatatagtaggagcataagatgatgtgcacctgaaggatagcgactgcgggtttgcttgtcattaaaaacaaaggtccaagatagggacggtaaaaacaagagattatttttcctaaaaaagttcattcagctatttcctgcaaaaatcattatctttttgttctggttccactaactgctaaagtttggtcctcaatgtatgccttgttagcttgttaatcatttcttggtttgtagtaattaaatgcatgaagtttcatatcgtgttggtagcaaaacttgataagaagctcataggtcttatcatgctaaaaggaaagttgaaggagcttaacaaaaagaggaaaatgaatgtggtctttattgggaaaaaaaaaagaggaggagaaagcaaagtagaaggaaagattggagaacccgaacctcttaagctttggagcctatttatactttgaggagtcatatttttaccgaccagcacaatcggaaaatgtgatttattgtacttttatgtgcttccaatttttcttactttaaagggttaagaaatgaacagagtaaaaggattcttttactttgtcattctttaagtgacgaaaggattaataaatattagttatagacatctataggagcaagttccagaaaattcctttttatcaaataaaaaggctatagaggattctcttttagttatttgataagtatccataccttttgcttttttctttattctcattcactgttggtggctgtagattgatttacccgaatctgtcccagtgacaactctgtttctcaggttgttgcaaatgttgcatcttttgaaaatgatatataagatgaataatgtagttgcaaattttgaaacctttttatgtaggtttagcaggatggtaacgaagagtctgctagtgcatctagggtgcgatgtaacaaccattggctccggtgatgagtgcttgagaatccttactcgggaacacaaagtactaatcatggacgcaagtataacaggtatgaactgttatgatgttgccgtcagtgtacatgagaaatttggaaaacgtctcgagaggccacttattgtggcactaactgggaacactgaccaagtgacaaaagaaaactgcttgagagttggaatggatggagttattctgaaacctgtttcaattgataaaatgagaagtgttttatccgggcttttagagcacggaactgttctttaatcccagtaaaccaaaattgtctcaagactcgtactcttgagtctcagaaatcagaatacaagtgtgtcgtaaatacaatctccgatttttcgcaaaaacaacgatttgttcacgatgatgatgcagtatggctgattgcagtttcatttatcttatgtaatcctcagtagctttgtataaagtagttaggtctacaatctatgcatatatataggactagttaatgtctttcctgtaaggtttgatgtaagaaaaatacaatgacagtcgaattcagctcgagttttaatttgtttgtcttagtgttctttttaaaatattggcaattaacaccctacatgtgaaggaaaggaaaccaaaaaggaaagggaaataaaaaaatgtttccaacaaccgatatataaattatagtatatgatatgtatgctaccaactttggtaaggttaataattaatttatgaaatgattagtcaaaaaagtagggaattctgaaagggcactaatgatagggcagacaatttgcttcctcaattgtcaattttttatacaaaatataaacaataatttaacttcttcttgaagagtcttatcaatttaatattacacgagcagcactttttaacgttagagaatatatggtgaggtctcggtctcgatcataattataatatatctaatataattttattatcgagttaaaaaatatgtatcaagattccaccaaaaaagaaatatgactacttaaacctcatctatttttgttaggagtctcatttatttgtttctatgagaaatgacttaatattcagatctcataaaatatatatttatttcttagatttaaattttaatttgtcaaatatcaattaaaggatttattttttcatgttataccatttaactgtttggatagagataaatgattcaaaactttaatattattaagatgtttattcaaggacttgtataactacgaaacatcatcaattcaattcattcatcgacatgactctatgtagtatatcaagtacgtactaacaccgccgcccacacatcttatcaactatatatcactatccacaattactgtcatcgttatcaatcgctatgatcaattgttatcattactagtcatcatttattatttgcaattataatcatcaaccatcattattacaacaatcactgcaatcaccatcactattatatattgtcaaccaccatcaccattagctatcactatcatccatcacaactattagtcgtcaccagcaacatgactatcactattaaccattactattaccattaacactacaacagtatcaattaccat

SEQ ID NO: 304 - DNA, 4127 bp, Solanum lycopersicum
tatatatatgtttttggaataatggacagataacgttgagaatgccgagatctcagattcaaatcactatttataaaaaaaaaatcactaaataattttttctcatctatcttaatcttggcggacacggttacctgctatccattattgttgaaaggttacaagtcgaagaagctagttagaaaaagtttctaaaataagaaaaatacaaaaaagtggagaaaagggtgtggaagtagagagtggtgaattggaactagtctcatttgaactaagtctattcaaaaaaagtaaaattatttcaactgttgtatccgtaccttttttctctgtatgcaaatgcagaaaagcacattgctattcacgtatctctgatcctatcccagaaattttgtatattttcaaacttaagataattttaaaacaaaattttatttattttatcttggtgtaaaacgtaattcacttatcttttaataaatataaaattacaaattgataacttttagttagtactaaggtgatagatagcatacgtttcttttatatgatgctggaaaagcttagtaaattttaagatcaattctagagcactatattttttcaaattatccagtaatacttatcaagtgatttatcgaaaatgaatttaagtaatcattaccatgtcatctaaatcacatctacatatacatatttaatttcctttaaacgttgtgtttgtaattttttaatataacaaattactacataaagttaataataatctgatgatgaaaaatttaatttattgatagtgtattaaactcacttttaattatataatactctttgatttatacgaattaatttttttctttcttaaatttatatcactggggtaaataattggctaattacgtagaatgatttaggaaaaaataaagtatacgcaggcagttgtaagtttgtaaatatttatttttacagtcgaagttaaactcttataaaaagcaacagtttttcaccttccattccatagtaacccaagtgtgtgcttctaacaacatggacccagatgctttctcggcgagtttgttcaagtgggacccaagaggtgcaatgccaccaccaagccggttattagaaccggtggcgccaccacaacctcctccatctctaccaccaccaccacctcctcagccgctcccaacatcatcctactccatacggagtacgagggagctcggaggactagaggagttatttcaagcgtacggcatacgctactacaccgccgctaagatagcggagttagggttcactgtgaacacgttattggacatgaaagatgaagaacttgatgatatgatgaatagcctctcgcagatatttcggtgggacctactcgtcggagagaggtacggtatcaaagcggcgattagagctgaatggcggaggctggaggaggaggaagcacggcgccgcggacacattttgtccgacggtggaacgaatgtccttgacgctctatcacaagaaggtaccaaaatttcaacttctcaattacatgcactgaattgtgctaataattttgtttcatgcactgttatattgatttttaaattttcctgcttgcatgcaattcattgtttttcaaatttgattttattttagtatcactcccttttataattcactttcatacccccaccaaaatcattgcacataaaatgaaagagatcgatcaagtaaactagtaaattgattcatgtgttaatgatgaactagtgacaattgtttattatacgtttaaaatgatcttatacatatggtgaaaatggtaaagtaggattatcggaggaaccagtgcagcagcagcacgagagagaagcggcaggaagtggtggtggaggtacatgggaagtggctgccggtggtggtggtaggatgaaacaaaggaggaggaagaaggcggggagggagagaagaggggaagaggatgaggaaacggaggaattaggagaagaagatgaagaaaatatgaaccaaggaggtggaggtggaggaataagcgagagacaaagggagcatccgtttatcgtgacggagcctggtgaagtagcacgtggcaaaaagaacggcttggattatctgttccatctctacgaacaatgccgtgatttcttgatccaagttcagactattgctaaggaacgaggtgaaaaatgccctacgaaggtcaccttccttttctctctttctcatttttttaaaattataaatatcgaaataatagtcgagctctaatacaagggtctgtgtataaaaatgaatgtggtaacagaggacctcgttaattgggtctaagagtaaccattagctgtccacaaagtaaactcgacagctaaggtacggactgatgggctcaaccataaagcttgtcttgccccattactccatttgtacttccactcaagtacctccacctgtaaccttgtccttaccatatacatagtctacaccttgaccatctcgtattgatgaaagctagcatgtatccaaaaaaaaaaatagttaggtagacgtaatttaagacaattacgtaaatttatcgcatattgattcacgagtgtgttgaatatgtaggtgacgaatcaggtgttcaggtacgcgaagaaggcaggggcaagctacataaacaagcccaaaatgagacattatgtgcattgctatgcacttcactgccttgatgaggatgcttccaatgctctgagaagagctttcaaggagcggggagagaatgttggggcatggagacaggcgtgttacaagccattggtggctatagcggctcgacaaggctgggatatcgatgcaatcttcaatgcacatcctcgactagccatttggtatgtccccaccaagctccgacagctgtgccattctgaaagaagcaacgcagctgcagctgcttctagctccgtctctggtggtgttgctgatcacctgccacatttctaattgtgcttctgaggatgactgcagtttacaaagtatatctactgtgttaaatctctccgacttccctacttttttctactcttgatgtaatctttcggcttaaagatcaaaattttctgcataacatggaggtccctcatttcacttctgcaaattctgtaactgcttaaagtttaagatctctaacagataatggttcaacataatggagaaaaacaacagaatagatctctcattgcacaagtatttactgtcactttgatgtacgatcgtcaaacaaattgtcgatgtgtaacaaaccaatgcgctaataaaaattctcaattcaagggatcaagaagaatgagtagggtatttccataacacatcaccccaggtgctctgcccatcagttacctccttaataacagatgctacttcatcaacattcacacgaatctgctgcttgctgtctctttcacggatcgtcacagaggatgctgaatccactgtaatggcaaagggaactccaagttcatctgttcttgcataccttttccctattgacgtacctatagcacaaaatcacatggtcagtgaagaattatatagtcggtcgacccaacttgtatagcacttgaggcatagttattgtattagcagttcatcaacctaaaagcatataaacatattttactgctacaataaaaccaggttatcataatttgatactgctgttgctgacatctcatatattagtcaatataacttctttagtaaataagggaaacttaagcatatatatgagtattgtataataacagtctccggtgcacacatcttcagatatgaccagatttatatatcacaaggagatcagcaacataatggatagcgcacaaggataaattggaatcccatgaagtcaaaagaagaagtcaaactcaaatttctgcatttagacgatgcatacacagaacttctttggcgtgtaagcaccaactttagccagactttgaagttactacctatcctacttagagggtcagcaaacaaagttgatagacggaaaatattggccgggacaggtggaccttaatgaacatcgacaatacattatgtcaattactcaacgtgaatctaaa

SEQ ID NO: 305 - DNA, 4650 bp, Solanum lycopersicum
ggaattcaggattaaaattagtaaatatggtgataataggaataatttaaataaattgtatcacgtagttattattattaaaaagtaatatgatgtattaagcttttcattttatgctatatttaggaggaaatctgaattaaaataatctattatacacaactatactttatatttttgtaagagactatatcttactcgaacttatgactaatcataaaacaataattctgctactttaccaacatcttttaattatttttaatgagcttaagaaaacttaagccacaattgaaataggataaggagtactaattgttaacttagttgaatcctaatcccatttgtattaaatactaatccttcttctaccaattagattctttaccggtcttttgtcccaatgttcactcccactgaaattcatacttttatcttttcactaattatactaaaaaaaaaaactcaatcaattaataaagaaatcaaaacaatatattattaaaaccaaaaataactaaaccatcaatgatctagtcaattaattattaattagacttcaaattgttcaacttttagaatgatttaacacctagatcctagaagattagttattagttgaataattaggagattatttagcataatttttgccattaactaataacaagtcaacaaaataaaaattagcaacaaagttcttcaagattttccttctctcccccttttattttattttttagcactagtttaactaaaaatcgtataaaatatttatctattttttctaaaatcttcacttttttttgtgggatatttttctgtctttaatcaagataattaaggtcctacatccacataaaagtgacgtgccatttaagattaataataattactattagcatttttttttggataattattactcctactacaatagtttttttaataataaaataaaataaatctctatgcgtaattaaatagttttctcttcttcatagaactcttcaaccaccttctatataaagctccttataattttcacttatcctcctcttcttctctctgttatactatataaaaatctatagatacacctatagatacatatattttctctattcatcgtagccatggcagttaacggtgcttcttcttctggtttgatcgtcagtttcggtgagatgttgatcgatttcgttccgacagtctccggcgtatcccttgccgaggctcccggatttttgaaagctcccggcggtgcaccggcgaacgtcgctatcgcggtgacgaggctcggagggaagtcggcgttcgtcgggaaactcggcgacgatgagttcggtcacatgctcgccgggattctgaaaacgaacggcgtacaagccgaaggaattaattttgacaagggcgccaggacggctttggcgttcgtgacgctacgcgccgacggagagcgtgagtttatgttttacagaaatcccagtgccgatatgttgctcacgcccgctgagttgaatcttgatcttattagatctgtaagttatttaatctgtttttttcttcccaactcgcattggatttgatgatctgtgcgtgtttctcacgtgcaatttcgtagttttgtgatcacgaagaagctggtgagtttgttgttgtttgtttttgactcaactgtagtaattaattaataaattgaaaaagacgtaaaacttatttttatttttaggtgggttggtttggtgtctttttttttttcgactttactgtcatttttctaattaacaacgtatcatttttttggatccgatccggaatcgcttagtatgcccacacatccatttcaatagcgatttcgcttttgtaagtaaaaggtgatccctatccacttttttaaaattttgtttgtttaaagagagacagctagaattttgtcacttaggattttagttagagataaaattaggaattattgtgttgcatgcaattaagatgaaggtgtaagtgacacggatttttcttgaagagtgggtgagtgttgtctgttagcttaacacaacttttcctgcctttcatgtgttgaaatctcaaaaacctatgctttgtctctttctcttttgttcccacttgcctcttatattgtagatttttagttcacatgatatttgctacaaaaccaaattgatttgtttgcattcaaatgggtagtttatgtgtttattttttcatattttgaatcaagcgaaaattctagcttcacggaaaaaagtgtataatgacgatacatactaggaggaatagtatagagtgtatcgaaatcgagtggagccaaaaggggtaggtggggaagtatagttaaattcatgtcaggtgtcattatcatggagtcagtcattaattgtagctcacaaactaattaatttttgtatggattatagtttaatttgtgaattttgtgtatataggctaaggtgttccactatggatcaattagtttgatcgtggagccatgtagagcagcacatatgaaggcaatggaagtagcaaaggaggcaggggcattgctctcttatgacccaaaccttcgtttgccgttgtggccttcagcagaagaggccaagaagcaaatcaagagcatatgggactctgctgatgtgatcaaggtcagcgatgtggagctcgaattcctcactggaagcaacaagattgatgatgaatccgccatgtccttgtggcatcctaacttgaagctactcttggtcactcttggtgaaaagggttgcaattactacaccaaggtatattctatcttttggtatttcgttttttaaataatttttatactcgtaatcgttcctattttatttaattgcttattattgaattctctagtagatagctgtaaagtggtaggtaagaacaacttagacgaaccattgttgtttaatttgtaattaaagtaagccaaggaggacctacaacactaaattagtgtgtcccctcatgcctaataaaggcgtttattttttaaattagaatagagaatattgtgtaattggttttgataatttgatctgacttagttcttttttggggtgtagaaattccatggaaccgttggaggattccatgtgaagactgttgacaccactggagctggtgattcttttgttggtgcccttctaaccaagattgttgatgatcaaaccattctcgaggtaaaataattaccttttcttagaactaatttaagcgataacgtgtcgtataatatactaatttgtgtggaaaaaaaaatgcaggatgaagcaaggttgaaggaagtacttaggttttcatgtgcatgtggagccatcactacaaccaagaaaggagcaatcccagctttgcctactgcatctgaagccctcactttgctcaagggaggagcatagaaacatcgtgttatcttttttcttttttccatcttcatatatttccccccctttatgagtttttttgaagctagtaggaagccttttcagttttggattttaatgttttgttgtgatgaatgtccatcaagacacttaataaactaagctttcttcatatgcagcttccttgtaacttctcctttacatcatcatactagtatttcattatccaattctatattctagtagacatagttttcacctatttcatttgtcatcaaatcctagtaaagttgggaattttgcccaagagttcatgagttcgatcatagcttcaactgttgtgtgcagtaattgatgaaggattgcaagaggctcccaggaaaactggcgcttggaacatgaatgttgcaaaaatatagagcataaccagcgcaaaattactaactcaattgctgtagcacaactagagatagaggagttgttgccaagaaaatttgttcctagggtagagtctacaaggtaaaatcacaactgtggagtagttcttgtaacaaaaccagattttactatgtagcaatatgcatagcatgtccaagaatgcatcaatatgtttataaaattgctataagaagaagaaattgatgcaattctaccaaggaggcgaaatgtaagcaagataaaggatatcttaagcagaatagtgtttcctctacttactgaacatgtctgttgacaatatgagcgcactgcgaaagtaagcaagataaggagtatcttaagcagaacaatactttttctacttactgaacatatctgttgacagtatgagagcactgattaagtactacacacaagcacacatgcacatttaattggaaacttcttgaagttggagttcaaccaagatcggggacagtaaaatactcatcatcatctgggatttcaattctggacttcttgtaaggcatttgatatttggttgtcctgtaaatatttgtattgctcgactgaggtactgatagctcgggcacttcagctgctgtttgttcaccaaagagatcaatgccccctaaccactcaaattcaccaagctcaagtagatccttctgtattagattgaaacaaccaatatataggttattcattacatattagatgaacagacaatgacaccgtaatatactgaatcaatggtcaccacagtttcacatattagactgacaccgga

SEQ ID NO: 306 - DNA, 13790 bp, Solanum lycopersicum
cctaatgtaagaatgtttcttcatccaaaaaaattaatcgattatgaaacttaaaaaaaatcaaaataattccatttttttccaacaatgactaatgaaacttagaagtttttcggtgagattttcccccccatctttctctacctaaaaaacgagatgaagtaaaaagttataattaataaaaaagctgatgaaaaggtaattttgtcgggatgaagatggcattgtacagggtgggggagggtcgctattaatggagttaaagggaaatgtatgttttgggtgatttaagtttaagtttttttttcttcatttttttactttaaaataattttctttttttttactttataatataatgttcattatttatatttgtcaaattgttatgtcagcgcgaatgtatttcacacattctctatttttagtttattctcaaaaaaatgttcaaatgattcaaattcagaatagtggaagtgtttaataggtagtatatctagttgaggtgtctaaatgaataatgaggacaagtttgagtggccgcatatgactttgacctttgttttaatttatgtgatatatttcaaattttgagatttaaacaagtttatttattatcataaattttttatatcttttaaatattttgaactatcagttattgtgacttataatactttttatgtagtttacaaatatataaatttcatttttaaaaaattaaaaattccataaacaaattctcaatcaaacttaattcatttaactctccaaaatgaaatatatcaatatgtcacatagattgagataaaagaaattagtaccttttcggctttaaaaatatacattctctatataatccaaacactttcaaaaaaaaaaaaagcttaaaaatcgaaaattactaaaaataagttaatccagaccccattaactaacacaaatatatgggaaaagtaagttaatgtttttggttttgtggtccgcaaatgaagagatacatacatcaatcccataaataaagatccttcatatatatatatatattttctaggaatctaattccttaactattttcttttccatcctctttcctttttcccggaaaatcggtacggaaatccttaatgtcttggagttttaatttatctagtttaatgttttgtgattttgaagccattatagtactatttttttgttcctgcgactgccgtccagcttaattttcatagctagggttttccaaagtccttttgttttttcagttgcaattttttttttttgctgaaattaattctaaaatatgtttttgaggtgtacttatagtccaccatctgtttcttcattgtaatttttattttttattttttttgtattcaatccatattaattaatttttgcaggaatttaaatggtgagaggaaaagtagaaatgaaaagaatagaaaattcaacgagcaggcaagtgacgttttcgaaaagacgaaatggacttacgaagaaagcttatgaattatcagttctttgtgatgctgaagttgctttcattattttctcacataaaggaagactttatgaatttgctagctccaagtaagaatatcttaatttttgattcatttcactctattcaatgtatacatttttttcttatttgcttctaatttcaaagtcaataggcgtgggcttaatgtactttgaaagtacgatgatgctgttttttcttctttttttttgaagttaacctcgtctatatcaatttgtgtttttatccactaatcaagtatatattatgtttggatatgtctagatagttttgaggtgtgagttaggcttaagatcaaattttacagagctaatgatcatgggtggagctaagatatgagctaattaagtaactttggttcaaaccttgcgtttgtcttgatctagaaccaagtagcttgaatagattaagataatctataatctttaaattttatctccgcttctacggatgattaatagtattttttttaatcctatctttgatttcaaattcagagaaacacttggatttaagtttgatccaattaatgtacgaccttaaaaaatatatgttgatcttttactcaatataaataattatacaacaaacaatatttcgttttatagaatcatgtggaggggaatgtgattagagaagggaaatagaacttaattgttaagtgtgtttactattttattggaagaacttaaatatgatatcagactaggcattgatcttgtttttgaatcaactccattagcacaatgaaacaaaaatttaacaacatacttgttcaacacataaaagaatcaagctcgtattaaatgtgtacttaattaaacactcatcaaaaaaactaaagttaagataatcattcaagtggatttatgagagataaacaaatttaatttgaagttcatattggtaagagacttggaaggttgagatgctagatgcatatgtgttattttatgcaatgtccaaaaggggtcctcttaatttattagagtatgatatcacttatacaacgtatgtttcttctacatcatgaggaaaatttaagtcgagaattttttgaaacaatctcttttattttagaaagagatagttataacatgtatcgaacatatttcattgagtacgttgttgtatacttaggaaagtcttctcttgagagtggggagtgggtgtggaggtacatatatttggttgcttttaaatcttttttgagcagtatatatggtactagatagtgttgattgctactgctatatatgcatctttttatgttaggtcaccgtcctactaatttctctagtacgtactctcattttttggggaaataattaaaatacaactaaaattagtctacttggttgtgtttggaaaaacctactaattaatggagaacataatcacaagttgatgaagaaaaataaaagttacattttccaagagatcttattacctaacctaggcagggccagtgagattattttggagatacttacttcccattacttctaaagaggttatttgttacgtcaaataagaataataattttgagattaattttattcatgtatctccccaccgattacttcaactgaattaaagaggttatttgttacgtgaaataagaataataattttgtgattaattttgtttatgtttggtttaaatgttaactaattttggatgtactaaaatggtaggattactcccatgaaatatcattgcttattatattttgtgtatcaaagagtttttatgtcatcaaaaagatatttatatggaagtcattgtaaaaaatatgattcttaatcctgaaaataagataagttatttattttaatgttaataagttataagtgatacgataatgtaaatagtctttctgctgacgataaaatatgacttaaggctcacaagaaggttgcactatacaaaattattttctagttatcaatgtgaaacttttatccctacatcccatcgaaataaattaaaactaaaagactattagcagctcgatcatgagtatttaaacttgtttgttgttagatcaggtgaaaatgttaatgttgtggaatacaaacttatcaaaaacatgttatattgattaagatacaattgagcaaccctcgagaatattaaatattttcagatgtatataagtgggaatattttaagttcaaagttagattacagaaatgtccttcactaattttaaaattaaaattttatttactaatttttaaaattaaatcaataatgacgattaaaactagaccaaatacatgattagatgttacaacttatcatttttcatttcttaatgaatttgattgttaaatttttttagcttccaccattaaacatattcatgcacaaacctttcatgtacttaatttttcctttagaaattgaattaaaaatattaatccaccccactttgtatttcatcatctaatagttcttatgtaagtagtattttttttattggtcactatttttcttattgatttgtgccttcgttcattttttattttcatggttgttggagaagtacataatctaatagttcttgtaatttttttttattggtcactatttttcctttagtttgtgcgcttcattcatttttttattttaatgattgttggagtatttatgtcccaagaaatttcagagccgtggggcttagttctagccttacaagttgctcatcattttttcaagtcgttgatgtttaagttctagacagaaagtaaatactaaaaagagtttattttatatgcacaaaaacacatataggagtacatcagacaatatcgagcaattctatatcttgagtctatataaattataacaataacagaaatcaaatgtgcaaggcacgtttccagaactagtatataattatatagtcatgacgatccattactgcttttacaataattattttggaatgattcagcatgcagaagataattgagagataccgaggacgtgcaagagaaacaacgacggtggacaaaagcactgaactcgagcactacatggaggtaagtattttctcttatgtgcatcaaacaataaccaaaaagttataagtatatgaggaaaacaattgattcctatcgatttagtttgtgtgatgtagtttaaaaatgatatgtttgggcttaaagaaagaattatattaaaacttatagtttaaaataaatacaatacttgtgtgactaatgaattagttttttaggaataaaatgtatatttattaatgaaacagctagaaaaaggtttgacaaatttattattgagtcactcttgaaaatgtcatagcaataattgaaactcttgaaaatgtcatagcaataattgaagggaaatccttgtggataattagaaagaagaggaagagtcattactgttgatccactaaggggagggatgtagtaaatgtaattcttgaaactacttgttaatacacatcatctcataaaatttaggtgttaaggacactaggcaatcgaaaatttaggtgttaaggacactaggcaatcgaaaatgtcatgtaaaatgaactaagaatagtctcatactaaaagaagagtaggaaatagctttagggacagaatttacccttgttccaaaaggtgcctcttcctgaatttacaaccacttcgatctgacaagccaaaggggccatattctatcatgagatagcgatgtgcattttctgttatcatcccttttcattgtcatttttgaagtaaatagaaaaaaagaagaggacttaggcaattcacattaaatacaagaaagtctactggtagaatatctcgtagaagagctactttgcgagaattttcaaatcattttagtctatgacacaacaaggttttttttttcaaacaattttatatcactagacagaatgtctagcggcctttattaataataagataaaaatctcaattgaataagtacaaacaaggggggctaggttttaccttatcaatactaatgaggtaacaaacctttactaattaataaggatgaagaaaataagagctagataaaatcaagtattctatgacaaatgaagatacttaaataatgcaacaatatatacgtcaagaagaaggttgagttatcaacctcaaacttctttttatatatgtatgaactaaaaacgatagtttgtccatctagagtaacctgaagtattttcctcttgtcttcttcttcatatccgtccaataacacttgatagttcatcacttcttcttggacttattggatcttgtcgaagttgttgaaattgttatatgattttgctttaccaatcgcataggcacctgcctttggaacaaattcttcagagccccttaccatcccaactatgttatcttccatgtgtctttttttttcgcttctttgttgcctaggtgaaagatcctcatccctagccactttatcaaaatatatatctaacatgttatcttcttcatcctcttcaaagaattcctctcccaaatcatcatctttttaaaagaattcctctcccaaatcaatatattggctaattccttatgcgaaggctcctgactcattcttctttgagatcacatttttaggcataaatgttggagcctctgtgcttaatttgctattcaaaggagtaggtgaaacttgttcttcttcatcaaccaaatcagaccacctagaaacattcatctctccttgttttttcttagagataatcaaatcatttgtcgatttagcacgagagagatgacatacctttctccatacatcgctctagttgattttttctagtagctgacaatggttcaaatacattttgagttgataaagttaaattaggatcaatgcactcagtcacacctttttctcgacttgaagaattacttcgacttattgacgaaacatatctttttcatgtccttgatgtttaaaatgagtgtaatacagtggaagaatatcatagacaattttctgataatgttcaataattttacccgattctttctccaaaaactgtaatcttacacgatttggatgcttatctagtaagtctaggattatcttaaccctagaagtgcttggcctgattcgatcttgtgttgctttatccactgcaataggctttcatgtctttgtttcaatcgataataaggacctcctcgcaaagagatctgtaggtaactctggcaatgaaattcgtacccaggctttaggtgtttcctctttagggttgaatgatggcgtccacagaaaaattctgaagaaatactcttcaccatcaaactcaaaatattcgtaaaaaattgatagaacctgtacaaagtcctcatatgaatcaaacctaatcaaaaggtgacgaaaatcaagttggtccaatattataatttcctttaacatcaaattgctttggtaaaagcttttgcaactcggataacaacgattttccataagcaaatttgataaactcaatgggctttagtatgattttaacaggttttggatagttttttgtggtttaaggatcgttgcatagggtgattttatatcaaggttgacgtttgtctctcccacggccagaggctggggagagggcgaagcagccatggctgctattcgagttgccatggagagagggaaaggaaagagtggggggcttgacacaagaaggttgtactatcattataaatcaaacttttactttgattgttattgacttgactacattatcacactgagtagtgttttctcatggaagaaagaaggagcttagcttcttaaagggctcttaataaagaaaactttttttaagaaagcaagccttttaagtagggcttgaaagaaggcaggcgatcaaagtgtccaatcaatttcatactagcttttagaaaaataatagtagaaaatgtaattaaagaagaagaagatggctttgaggcgtgtaatcactttttttgagttattgctcgtatacacattggagtaatataaacaattctcttcaaggatacaacaaaactctttgtttatacatacagatttttcataggctacttctagaaagtctttacattcatagaacttaagagatcactctttataagagtcatgttctttcatgaacatatgactgttcataaaggtcatgttcctttctgaataaaagactttttataatagtcatgttctttcatgatcacccaaatggtcacccaagttaagggaatcatcttaaaatatcaattatgtttcatttaggatcaaaatatcatcccaactatcactattttccttcaaatatacttgacaattcaaaagcatcactctctcctagttggcatgaaatgtcattgaagtcttattttaatatagactaatttaattcattaaactcatttaactaaaataatgatcatattgtttttaatttttttaattaatttatcaagaataaattttcatacttaaaatcttttatcataattaaactttttatgtttttatgttatgcagaatgcgtttttataaaacgtactataatctcattaattttaaatactaataaacacatagattcaaaaaatattgatatacaaatcactcatgaatgctaatttacttcaattaatcataaattgtataataaatcaataatattaaaaattaattaattattaaaaaatagttatttgggtacattgaaatcaatacatacttataatatcttttttaaaagaaaataataagtgaataatatttatagaatatgaaattttgatctttatttatcagtatattaatctcatataatatgcatactattgaattaaattagtaaattcaattaattattagtttatttattgatgtttaattgtatgaaaagttataatataatataatatagaataaaagaataaaaataaattcaattaaaaaaagttaataataattttctttttcttactaattttttgtcaaacttacaaatctatctaatacttttattaaaaatattgtttgaaattttcagataatttagttaggaattttaaaattatcaggtaataattgcatacagagattttttcatagaattttgtttggtgacgatatataaaattactagactttttaaattacttttcttataatcttcataaattctcatgtaatttatatatttattttgtagagacataagtttgatgaattaaagaggtctattattttttaaactgattatctaatgacagggcatatcaactagaatttaaggagatttttgaggtatttagtatttctaatggataaaaaaatataatattattcactttcttcttctttttttcaaaaaaaagcagtatcggaagcatgaattgcaaaatatacaattaatattcttgtaatagttattgacctttgatattattgatttattatacaacttatgattaattgatgtaaattagatttaatgagtaatttgtataaaaatatttttttgaatgtatgtgtttataagtattcaaaattaaaaaaatatagtacatttcaaaaatgtattcttcataacataaaaaacaaaaagtttaattttgataaaagattttaagtagaaaaatttattcttaatagattaaaaataaagtaataatatgattattattttagttaaataggttcaatgaattaaattagtctattattaaaaaaaaaatttaataacatgtcatgtcaactaggatagagtgatgattttaaagtatcaagtatatttggaggaaaatagtgatagttgaatgatattttggtgctaaatgaaacataaatgatatttcaaaataattctctttaacttggttgaccatttagggaattgactccaccacttgaatatacatataggtgaaattagctactatgtcctgttactatatacttttacttattacattaagaattacctcaacctctgtgtaataatttgcattatggagtttgttgctatgcccctgttatatcaagcatagtttaaggatcttaacctttatttgttcacacatttataatattacatcttttgaaacaaaattttacaaaaggtctgacaaaaattttagattcatattctttaatgaacatatgacttttcataagagtcatattctttcgtgaacatatgacttttcataagagtcatgttctttcgtaaataaaagacttttcataatagtcatgttctttcacgaaccgatgtgtctgctcaaaacctctatatattaatccaatactctctacttctactaccatcacccctagtattgcattatgaatgttcggtcatttgaagaaaatacagtattgcatcatttatgagagttcggtcatttgaaaaaaaagcactggatatcactaagtgtccttaatgctatgatattgacaattaggtcaaaaacatttttgaattcaaaatattaaagattatttggatcattcttccaatatatctcagccttaagggttagcttgcttccactagtagcctaaggggcgatcgaccttaagacatggtatggaggcgaaggtatggaagtacgacaatgcagtctaaggaggagtgggactttggaagctacatgaaagagaaaggacatagcttaatggaggagttagagatctatttgattccttgtgagaagatttaagtaggtttttgtttttctcatctggatgtaaatataggggactacacaaccttcgtgtacgtgattgacttctttctcaacttaaataaaggaagagatggattggagaagaattcattcctctccgagcagtgaagtgccatatcctagagagaaggctttaccgatcgttaagatagagttggtgtcggtagttgttcttttacttagatgactcttaaagctaatgagatgattccgataaaccggcattcctcattcctcagagaaaggaaaatctttcaaaaatccatgtggaagttctttttattatatgtacttcgataccatgttgaagtctgtgactgtgtcatctaccagcttaagcttaaggtgttagagcgagcacacttttgattagtttgtgatattcggttagaaaatgcaaaattagagaattgaagtgatctttgatttctgaatatgattagcctttaagtacaaaagtagttctagactactcaaactttatgcaataaaagcatctatgaagatgcgctgttctagactttacacacaagaaattctctaaatcacaatttacaacaaatatatccatgacattgagttgaagatggactgttaaaattttgctatatcagaatatttgtaattagtgaagaaaagtctaaaataatatgaaaagccatgacttatatattttaaaatggtcaaaaaaatatgtgcatctcttcaaggaagttcatatagtagagctagcaaagaatgaaatgaaattatatgtacatgtcccattctgcttcaatcaataatcatctctaggaaaattctaaacctcataaatcatttcttggttagttggttttaaacccttgaatccctctttaacaccccacctcatgcccagtgcttagcatctggtgcgtgggtaatttgattttgaggtcccaacatcaggtgagacagaccctgctttaataccatgtgaaattaggtcttaggcctaactcacaccccaaaagctagctcagaaggaggaggattgttcaagccttataaggagtccacccatctcatttatcaccgatatggaacttttgtcattctttgacaccttccttgattttgaatccgataatgatacaccattgattgatttcatttttgcagaacttgaagcatgaaacagctaatatggcgaagaagatagagatcctcgaaatttctaaacggttctccatttttttaatttactactcctttcgtaacacttattttagaacggaagaactagttatttacttaaattgggaaatttttaattgattaggaagctaatggggcaaggattagggtcatgttcaatggatgaactagaagacattgacagccaactggagaggaccctcaaaattatcagggctagaaaggtactaattaaattcaatattattcaatatttgacactaattttaattatttatccttaattctttaatttctcattttaatttctagactcaattgttcaaagaggaaatagaaagtctaaaagcaaaggtatgatcattgacaattaattatataatttaatgcattttaggccttttactaattggtataatgttaattctatgaactaaatgcaatttctcaggagagactattgctccaacaaaatgcaagtttacgtgaaaaggtgaactctctcatatttgttattttaattaatcaaatataatgtgaattctagaaatttttatattttagaacacgtttaataacacaaatttcaaccttttttttttatatatacataccaataacatacatcgaagagtcattatgatttacatatgttcatttatcttataggatattcaaactattccttttactatatgttacgctaattgttgtatttatgttttttttttacattaaaaaatatttctcaatccagtgcgggcttaggccaatgctatcagagtcagcatctgcacccgaacccataccagcaccaccatcaacaccaccagctcaatcaaaagaaaggggaaattgtagccaaagtacaaagagttgggaagtggagactgaattgtttattggccttcctcaaacgcgctgcttatagtagcttggatcagtggttgagctagggttttttttggtcaaaggaatttaaacctcgaagaagtacacagagaaggcaaaatgggttcaatctctactctatattacactaaattaaaagataaattttaactatatatgttataatattatttttcgctgtaggaaaatcagttaaacaccccatcaatcctacgtggctccgccccgaccgggacaatgggaccatttgttcatattttgtttatggttctcctcagttatttagactaagaggttaggatttctcagttatttacaaccataaggagttgcaaaattcaataaataataccttacaataagagtgtaatatttgcccctatttctttctatttttcatgtatttatagtatacttcctttctatttttcaaacattctaaacagctcaattgtttttgagtgtatcacaagtttgtttttggtttataatggattataaaatttataggtgaattcaaaattcaaaatttattgatttttgtaatgacttttctataataactaggtgcataattaattatttatgaatactacgtaaatttctttatatatatatatatatatatatataagcaacatctatacataatatacagaagaatatgtagacatatttaatgacattttttactgtccattacaaatattattttatttatatcattttttatatatatagaagatcagtaagtaaaatgcaacctaaaagatctaaatgaaaaacaaaaaatagtacccaaatctttacaaggacatccattttaacggtaagtgggccgcacccaacaatctaactcaccatatttagcccagttgtgctaaatttgcccgatttggtccaattgttacatattttttaaagaaaaaaattactagaataactacttttaataaataattactgagtttggcaatatattttaattattatcatttataattaatacataacaatattggagcttttgattgttatttcttcattcttcaatttctgtatacggcatttttgtgtggtttctcagcattgaatgtctattgggttagggtcgggggaggggtgtatatgatcgggttggttcggatttttcaaatatcaaattaaatcattcgtgcaaaaattttaaatttataaatcaaatcaaactaataaaactcagatttttttgggtttttcaacctcgggttggttcggatttttcaaataccaaaccaaaccattgtatcaaatttttaaatttataaatcaaaccaaactaaaatgcaatggataatatataagtacccctcaatttatactcgaaatctcgacacactt

SEQ ID NO: 307 - DNA, 4616 bp, Solanum lycopersicum
tttgacaatgctttttctgtctttaattacttgttcactttttaattgacatacctattaagaaaacaattattataatagtcaatttaccattttacctttattaataatagagtgaatgaattaaaaatttaatatttttagaaaaattatctttatcaaagtaattaattgagcaagggtataacagaaaagaaaaagtgtccttccacttgatttattaaaatagataaataaaagaaaaaatggacaagtaaatagagatacgagaataactaataaaggcaaaaacaaaatgtaatttatgtcataatcttcaatttttaaaaattgtgaaacacatcaaccgttcaattaatttgaaagtaaagaaatattattttgattgttctttctcgaactctgagtctttcataaatacaaagaagtaatctctttaacgataagatagtgataaggtttgtttatatctctttcacttattccattttcgaagatcatacaagatatgttattattattgttttaacaagtgatttgaatgttcgattgacctatttgacaaatccataatgttaacatttgagggtgaaactctaatcactaatactcaataatcaaaattaaaattttaaaaatactgaatcaaatatcgaacgttaatagttagtcattaacacgaccctaaactcattatacacctccataacaccaccaccaaaactctgcagcagagagagagagccttgagaaggagaaccaaatcctttccttaaccttcacgcctccattaacacacttcctcattaataacccctctgttttttcccctgttttttctcttcattctatgcaacttcgtagaagaaaaaaaataaaaatagccttaaagaggaaactcaaccccaccccctaatcccccccctacccccaaccttcactcttctttaaattcccacttgtttcactctacactttcacagagctaaaaagaagaagaagaagaagaaaaagtagagctacttaaccaaaaaaaaacagagcaactctgagtgtttgaaactttttacactcttttcaaaagtttaaagtgagaaaagaagaaaaaagctttaaccttttagatgggttgttgtaaagaggaagaaccaaaatggttgtgggttaatggacctataatagtaggtgcaggtccttctggtttagcagtatcagcttgtcttaaagaaaatggagtcccttcactcattcttgagagaagtgattgtattgcttctttatggcaacataaaacttatgatcgcttaaaacttcatcttcctaaacaattctgtcaactcccgttgtttgatttcccagaaaatttcccaaaataccccacaaaacaccagttcatttcttaccttgagtcttatgccaaacacttttctatcacccccaagttcaaacagagtgttaaagttgcagaatttgatggagtctgtgggttttggaaagtacaaactcaagattttcagtatttgtcgaaatggttgattgttgcaacaggggaaaatgcagaggcagttataccagaaattccagggattgataagtttaaaggaagagtaatgcatacaagtgtttataaatctggtactgagtttattaatcaaagggttttggtaattggttgtggaaattctggtatggaagttagcttagacctctgtagacataacgccattcctcatatggtggtcagaaattctgtaagtacatttcacctttttttttctttcgacaagagaaagttattcagacgataatagtgagtttaaagtcataaaaagtatgtattttgatctatttatcgttatttttaaaaagaaattaatcgagaacaaaagaaatatttatgattttgatgtaaattaaacattattaatttatttattttattttattttatgcaggtgcatattttacctagggaaatgttaggaatatcaacattttcaatagctatggcccttctaaaatggatgcctttaagaatagttgataagttgttattactagttgctaacttaaccttaggtagcactgataaattaggtctccggcgaccgaaaaccggcccgcttgaacttaaaaatgccaccggaaaaacaccggtactcgacgttggagcattatcacaaataaaaaccggaaaaattcaggtaaattttcaaaaatacttacatttagccaaaatagttaattttgtctaatggatgatttttttattctttttgaaatagataatgccaggtgtgaaggaaattactaaaataggagcaaaatttttagatggcaaagaaggagaatttgattcaataatcttagcaacaggatacaaaagcaatgtgccttcttggtttaaggtataacaaatgataatattcgctctctgttcgtatcaagttaaattacgttacacaaattctttttttgggtggggcaattggtaaatgacaaaagtgataataaggcaatgagtattttgttgttaccttataaagtttctagttttatctttactctcaatctcacatcactttcattcttacacatgcagaagcctacaaaacgtttcttaaaccaaaaaagagaatttctgatctcatttgtctggacttttccctattttttttcccaaaaataaattaaattaatgtgtgtacttcctagttcctatagcttgggaatacaataatgatataattcatgttacaattattaatttcatatttattgaattcctatacactataatgattagtaataatacatatagactaagtacaattatatattatgaaaatatttttattaaaataaataattttgtgggccaattttgaccaaagatatgcacttactagaccatgcatagtggcatatgtcctatggtttatttatatgtagtgaaagggtacccaactttttgagacttttaggtctatcacatgcaagattttttctatttttccaaaattaatgatgaaatatttaaatttcaaaaattttaatttagtactaatttttttttaatattaattttgtagggaagtgatttcttcacagagcaagggatgccaaaaacaccatttccaaatggttggaaaggggaaaatggattatatacagtgggatttacaagaagaggaatattagggactgcaaatgatgcaaaaaacattgccagggacataagtgaacaatggagagaattcaagggcttctgtaaaaacttttgtactacgaaaaatctatcagataaccaaggcatatgtttttagcctttttagttacagagttagatgatagttaaattttccaaaaaagggtctcaagttttggaaaaagtagttagagggttcataaaatgtaattttagttcttcaatattttcaacaagaggaaagttcatccttctatcttgtcgtttttcctattctctttgtaaattaatcaaattttttctatgtaattttctgattttttaaaaatatttttttacataataccttttcatttttcaaattgatcaaaatattggtggctctgctactacaattgttcaatgttattcttgagggagatgttaatagttttacattttagaaaaatgaataaattcatgttaaaaatttgattagattcagattacgtatagtaaattttcttcgaacttgattccaagacttctaattaataaaatagagttatactattgtaccacgacctatattaacaatgtatttacgtatatattcatcctaaatttatttatctttaaggagatccccaatatatttatgagtttaatttgatattccaaaactcaatataaaaagtcaaaggctgaaaacggagaaagccgttagatattatagctttttcagtttgttgagatcatcaatctttccttcaaattcaactttctttttatctctttcagacaacaatcttactttgctgatgccataaagtaagatacgacttttaatttgattcaatcgttagatatttatgtccttttaacttatatgtgtacatgtaaatactaaaaattcatacaaaaattttaaatatttacttgtccacgtccaaaactgaataacaaagaagacgagttaaaagacactttatatgtattataatgcgactggtgtatgtgtcaccttttttagtagtatattgaatgtaccatagaatagacctaacccccacctaaaagtaaaacctcccaagaaagagtaaaagggctgagaaaaattcacccaagtctaaggtatagtgtgagggaaatttgaaattaaaatataggttaagagtgatgagggaaacgtgcagtgatattattgagtactagttgtagtagtttccctcatatgcacgctgattattgacacaatcatggacctctgacatttatctattgtactatatattatacgtcctatatttcacttacatatttttattcgtaatgttgatcacattcttaatcataccttacaataattatataaggcataatatataaatgtgcttactaacttgacttcgaattacatttatattat

SEQ ID NO: 308 - DNA, 8786 bp, Solanum lycopersicum
tcaaattcatattcacatttgatattggattgatatgttaatattatcccctattctatctatcttattaaaccatcatttcagaatttgaaatcgttcgaatttaattaaatccgtctatttgacatccctacgatcaaacttatttgctcagctgaaaattagtgcatcacgttggcaaaatgcccgtataaatagacgagttaaattaaatccgagtgatataaaaatgaataataattcaagtagtctataatcaaaaccttagaacaatagggaaacattttagtatggaattattgactactatatgaagaatatattgaatttattagtactcttttctatttataattaaacatttttgtaacaaccaactactatatcgatatttttcaaatatttctttgtaatgattaagttattcttggaatcaattaacaattgcaaatatatagacaaatgacgttattctctaaaattaaataaaattagattgagcctatctaattgatcgataaaagtcagacacaccaactggcaatcgttttgaccctcttattttaattcttccaaatatttatgttcatttttaaatttgaagtacaaaattcattcttaggtccatttcattttatacatgttagtttaattgtatatgtagtttaagaaaagtaagagcaatatagaaatatataatgtactaaaatattcttaaattttgtaattttaaaaacacacaacgaaaaaagctcaaatatctacctctaaggttattattgtaaatcgtctgttataaataaataaattactaatttttaaaatattataaattaaactgaaatgagttaagtcgagacagaccgaacactggaccctaatctaacacacaccaccctttgtcccatacaatgccactcattttccctcctcatagattcccctcctcttcttatatatatttattataaataccatatatatcttccatgtataatataatataatatataaatatacacacattattaattctcttcataattctctttcatcttatcataattataattcctcaacttccaacatggtttctgaaaaaattcaagaaaatattaaacttccaatcattgacctttcattagagaaatcacaaatattaaaactcatagtgaaagcctctgaagaatttggttttttcaaagttattaaccatggtgttgacacaaatgttataaaaaaaatggaagatgaaagttataattttttttccaaatctttttctcaaaaacaatgtgctggtccagcaaatccatatggttatggttgcaaaaatatagggtttaatggagataatggtgaagttgaatatttgttacttcatgccaatcctaatatgtccatctctcaaatatcaaaaaatatttcaagtgatccactaatgttcaggtaccttcaaactttggtttaacttattattaagttatatacactgtcagtatgatgatcagatgtctcatgtatccagataagttttcttatcaaactgtgagattcgtaattttgaaaataagatgtgttatgtttcatgtatccatataagttttcttattatcaaactgtgagattcgtaattttgagaataagacatgttatatagtgtaacaagtagagatgacagacatgatagtgtgaaattttcgtaaactaataatgtatatgtaacttaaactattaaaagattgagagttttctgtcgattttaaaaagaatgattttcgtatcgaaaaattctttcatattgaactttttgttttaccttcgataacatatgttctttgaggatttttttttatgtatattttgaatttttttgtttttaaaattttggtatgcaattaaatattattagagtaaaatctcatttatgtgagttggagagagatatatgtttagcaataatattatgttagtaaaataatatatggtttagttggatcatgtatataagacttcgattatatggtattagcagatttgaaaaataattagctagtataagttttgttagtacttttcatgaaccttaattggatatttttatattaattttaattttaatttatagtggaaatctatttttattcataaacttgattgaatctcattaaatgttttatatttttttattatatgttttgtgcataattgattgtgtgctagttaacttgtaataaagttaaattgttactacttgtacaatttaagaggattaggaagttgaagaatattaacttgtatcatgttagcttgtgagtttgatattttatatattcacccaactaataattactttcccgtttcaaaaagaataacctgttttttttcgtctgtttaaaaaagaatgatttttttctattttggtaatattttaatttaaactttacacgtgacatgtttaagagcacaagatcaaaggacaattttgtacatttaacttatttttaatttagaaccacaagatcgaaaagtcttctttattattcttaaactccgtgtcaagtcaaaccaagtcattttttatgaaacggagggagtattattttataaaaattattgtttcttatttaagaaaatgaaaatgactattgaaataataacattatcatgcaccctaggatgtcgtgacttagttgtcaatgtaatgattgggaaccgttcaaaattcagcgaaaacaaaaaaaaaactagataaattcttctcatctatcataggacagagttatctgatatctgttatggtggaaactgatattaatcgcataaaattaattaaaatacataaaaatttatccgaacaacacaataattttttatttttttttaaataaaagacactatgagtagagtgatatgaacattgttatttgtcaatttaggaataaaaataaatagaatgagtagtaaccatatagtacatatatatgtcaatttgtgctagtttgtgtttgggaattgtttggttgttccagctgtaacaactttgaacctgactcactatgtttgatctttttaagggaatcctactaggtacacattcacttcaatttcaaaaaaacatcatgtaaatcttgtctatacatatatcatcgatctttctgtttcgatttgtttgttttgttttgattttgtatgaagttaacgagaatgaagagaacttttgaatcttgtgaaattaaactaaagatatgtaaaatattaaattagttgcgtcgaagttatactgaatagggtgtattagtaatgataagattagttatgctaagttgctaacataatttcttatctactgtttaatttgttgtattaaaatggattagggtatattagaatagaaattataggatgaattagaataaaaataatacttttgtatggtagatgacatggttactaggtatataaaaataatattgaataaaatatatttagatatataattagttatacataggttgaaaacactatcaaataaagaattaaataaataccaaattaagttggtacgtgtattatattctttctaatatatatcacacacaaccatccctaaaggttgcaccgatggagtttaaattctaattacatcttcgacggagatgaatgagtctgaatcataatcgaacatgacacatacttaatgaactttgttaagaaataaacttaccttgctatcagataccactccagccatagtagcgtactcataattctaacatattatatccgagtcaagatcattataaattcgattattattgagtaacaccaaacttatgcctaaggcaaggctcaaatgataagatggggcaagggtcaaacattacttattgtaatagtaaatcatgtctattacgtgttttagatacaaatttccaaaaacttttagaattatgaatcgtattattttaatatatttcgtactcaagaactatctcgatttatctcatatatcaaacaacccctttaacatgaggctcctagcatatgggagttgggggcacaataggcatttgtgtttatccataactacaaaatctataataataattgaatgattgatatgatgtgcttgtgatagttgatcatcctatttacacagtaaaagttatgtactcatgaaaataacattttatttattaattattaaagatgattgccaagtgactatacatctatcaacaaattaaagtctaattacatcatgatgtgataatatttaatttatttgactttttgatttgaaatatgctatttcaaatatgttatatattataacaatatatttaatattatttataaagtaaagctcgcagagaatagtgtatatacatatattatctctagctactttattagataattcaagataaaaacaatctaaaaaagagttaacatgaagtagttaaaattaaaataataccccttctgtctcattttatatgagttaattttactcagtatgaagtttaaaaatttcttctttttttttgggaaatttgtgatctaaaataagtaataatcgatatttttgtgattataaatcatttcatttagggataaaattgacatttaaagctaaattgttacttaatatagaatcgtgtcattctttttctaattgattaaaaagaaaaataagtcagatgaagtaatagatagtagcagaacaatgctgcaacaaaaaaataatttctataatcaagctacgtgaaacaacaaatatatagtaacagaaaacgaaaaaaccaaaaattacaaatacaatactacaattgttagtaaggacgtacaataagacaatgtacacatacctactagtatgaatgtatttctacttattaattttctaccgtaattcatatttttatatttttttcaataaacgttaaaattattaaattctatcgaactcgtaaaatgacagttgtgcagtaaatggatatgtaaaatcagtgagggagttggcatgtaagatattagaattgatggcacaaggattaagggtccaacaaacttcagtctacagtaatcttctcatggaccttcattctgattctctactacggattaatcactaccctccattcaactggaccccacatcttctccatcatgattgtgacacgtcacctaactcttgcaactccacggtaagtaaaattggatttggagagcatacagaccctcagatcttgaccatcttaagatcaaacgatgctcctggcctacaaatatcaactcaacaaggattgtgggtccccgtatcacctcacccgaatactgctttttccatcttcgttggagacactttacaggtcagtaatttctttcatcttatcattataatttttttttacgaaaaatataaaatatatcgttgatcgaatgtatgttaaattccttgaaaataatgtactttgtaagctatggcacaaatattatctgaatacatgaaattaactacaaaatatatcgataatccataacttatatgtagcttaaatagactctagttaaattggatgtttttataatttgttgaattttactttttgctaaatccttactttttagtagtgaaatacgataatatttatgaaaaaattgagtataatggataaattttatcttgactattattatgatatataattcagcatatttgatctgtaattaattaaaatgaatattattattcttttaatatatttgcaaaattgcaaatagatcaaactaaatatatttagttagatattataaagactaaatcaatcctcgagtaacatagaaattgagtattcaattttatttgagtgtattggaccttcaacaagttatgattcgtgtgttagcgggtcaattcatattgtttagaggacgattttgtcaatcgatataactttataatgttgtgatcatcatagagactgtgattaaatggacacagactttatgatgaaagaatttctttcttaataatagtgtgctaaagaaactcgaataaatgaacctatcaacatcatagtaattcttgacttatttgaggtaacacaatgtggtccttactccacaatacttcatgagatgttgagcccattctttcttcaaataatgcatatcacttttctattccgtttaactatactttattttaatttgttcgatatatttttaactttatgttatttcaaaacttatatatatatatataatgatatcatgttttaaatatctcaccttattttaattaaaagatatatgaaatctcattactaatcacttagaaggatagttttcatatatgtgatttagatgtcgatttttttttttggattcttttaattccttattgttttgattaatcgtaaaactaattaagtcttgtttcttaaaacttactcaaggttctagtgtcattttattaacaatcaattattttgaatttcgattaaattaattttatcttagcttcaccctaataatttggaatataatttctaataaggaaaagagtcaatagaatgttatcttatgctttgatagtgacaaagccaactagctgagctgattggacccctttaattaatcaatcaatcaatcaaccaaatcaaacttgaattttaatcgatacccattaatatttttagattcggtattcagataaatagcacgacgtaaagaattgctttcattatcttaataaaataattcatagccatataaattgtcaaagaccattttatatcatatattaaattaaatcatgtcacataaattaaaatacgaaatactaatactagtaggtagaagtagtactcgtgcatagttatcataaccccacccctcatgataaaaaataaaagcaaagaaatgaagtatgtatgtagacctaagtgaaagctacatgtgctttgggagccaaaaattgaactcatacactgcaaatattcagtgtcacttcattggggggttttagatgcccaactattggttactatgtaagattctacttgataataactcatcactttcaaattttggagggtccatcgatttcgtctggttgaatgtattagagaaattaatatatgtacttgtcatgataattcgatattatagagtattattgtagaactgtctttcataatctattataaaaagatctaattaggagcgtagttagtagtttgttgctcaaataatatatttatgttacgagtaaaattatcattgtgaaattgagaatctataaagttgaaattttaaatatcacgtttgattctgattgtgtgtaggctctgacaaatggaaggtttaagagtgtgaggcatagggccatggtgaattcatgcaaacctaggatgtcaatggtgtactttggtgccccatcaccccatgctagaatttgttgtcccttagaattggtcactacaacaccacacaaaccttatcatctatataggccattcacttggggtgagtacaagaaagctacttattcgatgagacttggggacactcgtcttgatcaatttttcagactacaatcagaaaatgatgaaacaataactattaataatcaaacgtcttaagtttgaaattttggaattttttttatttcgagaatgacgctattagcaataaattatgtaattcagatatcgaacccttgatgaaacatgtaattatgtggagtccaaatgtgaagtttacaagttcataacttcttaggggatgcattgcatatttaagttactcaattaaatatttatatacatttagagagatcttcttaatataaattcatgttttaaataaacactattgatccaaatttgtcaaattcatatctaagttaatgtttttgagtatagattttgagagtacatttaaaaaattaatcttcaaatatttatttatccatgatattaaataaaatatttcaaattctcgaagattcaaggaatcatcaagtaaaatagatgtccaaataaaagtttaatttctaaaattacaattcattcatagttcatcactcacatgttctgtcatgtatgtagatatttatcttctttaatagtgatgtatggatcgaactccaattatatcagataaattctaaatattaatttattttctctaaaactattgttattttatgagttttacattctaactatgggaaaatgcacaagtacctcctcaatctatgctcgaaattctagagacacacttatactatactaagaccctattaccctcctgaacttattttattatgtaattttttacccctttttagtttacacggcactagtttgaaaaaaaagtcaaccatcgttgggcccacaagatagtgtcacgtaggctaaaaagggctaaaaaattattaataaaataagttcaggggataataggaccttagtatagtataagtatgtctttgagatttcgggcataggttgagggggtacttgggcattatcccaaaaatcaaatatttcttattttttatctgaaccatcatatataattaggatacaccttgatgagtaaataatactagatcaagtagaaaaaagaaacatctatatcattaacttaatcaaactttgaaatttaattaatgattacttcagatagaaactaactgtgatatccattgaaagattaaagataccctaaactattaaaaaattcttaaattcacacataaattatgt

SEQ ID NO: 309 - DNA, 3534 bp, Solanum lycopersicum
aattggcaaatgatttaattaggaaagtgtcatgtttgatgtgttgatctgatatatttttcaaaaaaatcttaatagaagtgtatttaattgaactaatcttattaatgatattttacgactctaaatttgactccaactattattaatttatgtagttaatttaatattaaaggcattgtgaaaaaaatataaaattcttcatttgttaaaatggataagagtatgtaaattcatatggtttaagagttactttagattgtttctatcgtcttactatttataggaacacatagattggttaatatagttatcgtcatttatttgcataaaatcgattgatttcatattggaagtcatatgttaaaaactatacatgttggcaagtgatgatatttcatatagaacatacatgaatgcaaaaaagtttcctccgaaaatatggtgcgaattaactaaagtagtgtcattcaaaaccgttcgccgaaaattttagatatttatggtaagctaacatcgtttggacaataatattaggaaattcttacaaaaaagcaaataatttgaggccgactaatcaaacattacgataatctagataactacaaaatataatgtgagttttcaaaaatagctatttattatcagagctacaataatttctacaattcgcttaatatcactaatataactcaaaaacaataatatctaaatgaagcaataggatctcaaagtccaagacctcaacgacaaataaaaccaattatttacgtagtttttttataccttatttttttttccctttttgataactcaaacttaggatcttattgaatatagggatttaattgcttagcaacttaccttttatcacgtaatttatttaccagtttgacacccttacgtaaaatcctgcgtatgctccatagtgtggaggtggggtttaggactcaaaattccctataaatactcatccattcctatacatacaaccaaatacttgtcaacctaacacttaccaaaatcaaccatggtgatcttgtccaaacaaacctcattctttaatggtgttccattgattgacctctctaaacccgactccaagaacctcatcgttaatgcctgcgaagaattcggattcttcaaaatcataaaccatgacgttcctatggaattcataagtaaactcgaatccgaagccatcaagttcttctcctctcccctctctgagaagctaaaagcagggcctgctgatccttttggctatggcaataaacaaattggaacaaatggcgattgtggtcgggtcgaacacatcctcgtatcgacaaattctgaattcaattaccagaaatttgcatctatattaggtgtcaatccagaaaacattcggtaagacactaaaacaggggaaaacagagtaatttcattaaagtcctgattcgtcaattcttgatatttgttattgtaattgcagggctgcggttaatgattatgtttcagcagtgaagaaaatgtcctgtgatattcttgaaatgttggcggagggattaaagatttatccgacgaatgttttcagtaagcttttgatggacgaaaatagcgactccgttttcaggctgaatcactatccgccatgctcagagattgaacgattgaacgataataataatgatttgattggatttggagaacatactgacccacaaatcatatcgatattaagatccaataacacttcggggctccaaatattactgaaagatggacactggatctctgtcccacctgatgaaaattctttcttcgtcaatgttggtgactcattgcaggtacattgtttatttgcactttatgttgttgtctggaggaactttcttttctttttattattatcgtcatacagtaataataaaccttataaggtcccaaagcgatcaactacaccaacacaaaactaataaatgtaaaatatgtgtgtaggattccacacctaaaatgtcatatgtagatatttgactctgacacaagaatcaacaacttattgttattgatatagggtctaaatcctgaattgttcggtttgatttcgatcgcaggttatgactaacggaaggtttaagagtgtgaagcatagggtattggcaaatagtgtgaaatcaagattatcaatgatatattttggaggaccaccattgagtgaaaaaatagcacctttggcatcactaatggaaggagaagatagtagtttgtacaaagaatttacatggttcgagtataaaaaatcagcatataaaactagattggctgataatagattaatactttttgaaaaaattgcagcctcataataattttatttttggtatctaaaagtgacaaagtcccaccatgttaggaattatgggttgtcaagatgctcattgtgggcttacaaaaatagatgattggattcctatagatagcaaaatttgtattttcttatactgttttgtaactaccactcttgttaatcataaaaattaattagtctttcatagtttttgaatccacttattcatctacctaccaattttttgtgggacactttcaaatataggaatttaacaactttaatataggcaaaaataactaatgtttaccctattttacatatattttactataaccccatgcacctctctttactccaccctgtctgcctagaaatcgaaaagtgcatgttttggctttcaatagatagtgaaacgttatttataatgtactaatgctatatatatagatcgtaaagacttttttttagcgtaaataaaacaaattagttgatcaagttcatctactttgaaataaaacatcaagaacgcgatacaatacaagaacaagatattctaatgactaatagttgtttggagattttttttaatatcttttattctctgcataaccttcttttataggtcgaaaaattgaaccgtcaccactcacctcaatgtaaaacgactacatgcttgaatattgaataggctatctcatagcatgtgcttatactctaatgccttttggcttgtgcagatcattatgactttctcagtttaactacaaaaacagaaattacatatgttcattatatatgttagatatgaaaatcataaagtgtagtactctctccattctatttatgtgacacgtttaaaaaaacgacatattttatagtaatataattcttaaatgatctacaattatatatctataaaggagtaattcattgtgcgctttttgacactgaagaatgtgacgagagcaaatgttagaactaaaaagtagatttaacacaaatctctagtctttttcgaattataaaaatttcttaaatttagtggttatcagatatatctcgaaatgtcttgatagaccttattcgaatacatcttgtacatcccgatacaacacataaagtaatgtatttgactcatacactacataaagttatgtagtcggctgatacattgcgtaaagtaatctccagatatattg

SEQ ID NO: 310 - DNA, 3330 bp, Solanum lycopersicum
atctcgctcgccactctcgctttatatgcagaagtgtataattctgaatctgttttgtataaagcgagagaaaattatatatacagatgcaaaaatgtatatcttcgtgttatacacttaattatacaatttacaaacattttacttcaaatattgcagagaaaaaggccaacgaattatacaattgtgaattatacaattgcagtgaaatacaattttctctagctttatacaacataagtgtatatattgtgtttctgtttttgtataaagccagaaaaacatatatcttattgctatacacttataattatgcaatatacatacattttaattcgattcaattgtatgcaaagcaaattatataattgcagtgaaataggccagcgaattatacaattgtatatgtatagcgaattacacagttttatgtttactatagagcgcaattatgcaaactttgctatagcatacaaatatgaatttttttatttgctatatgtgaaagttatccataattaaattatccttccctaacccaaatacttcgtaaagtcagaatttagagttaattaaaataaaattttaattattaaatttatttgaactcgtatcttaaaaattaattcttgccatgtacaaatacaaggttgtataggaaaaatgatgatcacgaggaattttcctttttatatagtagcacataggaatttcaacttcacattgtattaggtcattgtaaacgttaaatttatattatcttttctttttcgatcgaacttatcacactaagtgcggtttacatattatttgcgactaaaaaatagcgattacgaatttatcaatacttgggcaccaagtcaaattagagtgacgaaaaatattaggccaatatactttttgttaatatctgtgtgtgttgagtgggtgggtgggtactatgttttccctatatataacgaataacgttgtttactaaattttcatcactacacagctaagttcctacagttataataacaaacaacaatttctaccaaagtttttcaaattctaaatttcatcaaaaaaacaacaacaatggtggtcttaacaaaacctgccattactcacttccctatagtgaaaaactctttcaaatcaccctcttacatcaatgatatccctgtaatagacctctctaaagccaactccaagaacctcatcgttaatgcctgcgaagaattcggattcttcaaagtcataaaccatgatgttcctatggaattcataagtaaactcgaatccgaagccgttaaattcttctcctctcccctctctgagaaactaaaggcagggcctgctgatccttttggttatggcaataagaaaatcggacaaaatggcgatatcggttgggttgaatacattctcctttcaacaaattctgaattcaattaccagaaattcgcatctgtattaggtgtcaatccagaaaacattcggtaagacactaaaacaggggaaaacagagtaatgtcttgattttatcgtttcttgatttttgttattgttattgttattgcagggctgcggtgaatgattatgtgtcatcagtgaagaaaatgtcatgtgagattcttgaaaagttggcggagggattaaagattcaaccgacgaatgttttgagtaagctattgatggatgaaaagagcgactctgttttcaggctgaatcactatcctccatgtcctgatattcaagaattcaatgccaaaaatttaattggatttggagaacatactgatccacaaatcatgtcgattttaagatccaacaacacttccggtcttcaaattttactcaaaaatggcaactggttttctgttccatctgatcagaattcttttttcgtcaatgttggagactcattacaggtacgcaacataccctcatcaaatttcatacttgtcgagtgaattagtatatgatcgttcagaattcataaacttaaaatcttgaatttgcgtgcaggtgatgacgaatggaaggtttaagagtgtgaaacatagggtgttgacaaacagtgtgaaatcaagactatcaatgatatattttggaggaccaccattgagtgaaaagatagcaccattgccatcactaatggaaggaaaagacagtttatacaaagagtttacatggtttgagtacaaaaagtcagcttacaagactagactagctgataataggttggtcctatttgagaaaagtttataataacggtgtatataacttaaactctttgagaaaatagttacatctaaagatccgactctttaggaaggactcgttatgttgaaaatgatgttttaaggtagtaatttaaagttattatcattatattaacacctagggcttatgagtttttttttttatattcgtatctcactttacctctctagtattcgttgtttagacatgggcatatgtaaaatattataaggcctatgggattatgcattttaaaattgaatgtgaataatttaaaaataaggaatcaggcttatgtacgcgtccctcttcaacgaaataaaattaaattgcttgagctaaggacctcgtattgctaggacattatgagaatggcactacgagtcaaggctcatgtcattacactatgtgccatcacatggactatagtaggaaggccacttagatcaataaagaaaaataaattttaaaatatcgactgactgaatcacactcacttatttagaatgatgatgtaagtattattgttactaaattatccatatttattagatttctttttagaattaagaactatcaataagaggatatagtggaagaacatactaatttgtgtcacaaaatttttaagatgatatttattttaaaataaaataatttaatttgaaacagaaagaataataaattatgcataagcatttgctaattaattagctcagttagctaaagacgacattcaacgtcaattaagctaaagttactgttagatattagagtaattattaattaattagtagaagaagcaattggaattcaatttgctgtaccaccacctaaaagtggtactccatttattttttatttgtgtgttttagtttttatttgaaattcattaaaaatatttttttgataaaatttttttaaaatattctttatatattttgagctattaacttttgtaacttataatattttaaaaagggcaactttcacatatagcaaacaaaaaaatcatatttgtataatatagcaaactttgcataattgcgctccatagcaaacataaaaactgtataattc

SEQ ID NO: 311 - DNA, 3435 bp, Solanum lycopersicum
attatatttattattaatggagtttgaactttgaacccttcgtacaaacatgtaagtatatcaattgtgaaaagtatgaatgagctggcttaatttcaaatttatgttaagtttgatatattttaaatatgttatgacaatatcttcgacattacttttttctagatattttacacaaatatctaacactatgtttaaatcaaatacaaaaaattcctccaacccttttctttttctcgcattacactaattatttatgatagaatgattatttttcatctatattatttatagcatttctatttaaggataaaattgacgtgtattttattttttttcaaactatatttcattacaactttcctatttatgattactcaattatgataagagttacatttattttgttccttttagactttacatttattttgttccttttagactttaccttatgacgatttttctatccacaattaggataagatctacgtgtatcttattctttttagactttacattattgaagacaatacatatttagacatattcactatcatatataagattatttatttatacttttgaaatattacgtatcttagcactaattaagagtttcgtaccatatgttgagaaagatacatgcattgttgcaaccaaatactttaaaataaggagagagataaacaagattttgtatacatgcaaattcacttagatataatacatttaaaataaatttgactatatatttggatgtatctgaacacaccaaaatataatgaaatatataatattcaaagtaagatatatgtaagtaattaaatttccatccacagtaaggatatgaattgcctatatatattttcataatccaacagtaagattatactgaatatattattaattcgaatttattgtgattttggacttgatggagagtcctataaataggacagcagggtgtttcagagtgttcacaactacaactaagttccaacagttgtaacaagaaatacttgtcttagatagtaaaacccaaagttttgatcttttcattgttattcttcttctaataaccattttaagtttcatcaaagaaaacaatggtggttttaacagaacctgacaatgatcacttaccaataatcaacagcaattcttgcaaatccccctctttcttcaatgatattcctgtaatagacctctctaaacctgactccaagaacctcatcgttgaggcctgcgaagaattcggattctttaaagtcgtaaaccatgacgttcctatagaattcataagtaaactcgaatccgaagccatcaaattcttctcctctcccctctctgagaagctaaaagcagggcctgctgacccttttggctatggcaataaacaaatcggacaaagtggcgatatcggttgggttgaatacattctcctttcaacaaactctgaattcaattaccagaaattcgcatctgtattaggtgtcaatccagaaaacattcggtaagtcattaaaagcagagcaaaacagagtgatgtcttttaatctcgattcttgatttttgttattgttattgttattgcagagctgcggtgaatgattatgtgacagcagtgaagagaatgtcatgtgagattcttgaaaagttggcggagggattaaagattcatccgacgaatgttttcagtaagcttttgaaggatgaaaagagcgactctgttttcaggctgaatcattatcctccatgtcctgatattcaagaattcaatgccaaaaatttgattggatttggagaacataccgatccacaaatcatatcggtattaagatccaacaacacatccggccttcaaattttactcaaaaatggcaactggttttctgtgccacctgatcagagttcttttttcgtcaatgttggcgactcattacaggtatgcgacataccctcatcaaaatttcctacttgtctagtgaaatagtatgatcgttcagaactcataaacttaaaatcttgaatttgcgtgcaggtgatgactaatggaaggtttaagagtgtgaagcatagggtgttgacaaacagtgtaaaatcaagattatcaatgatatattttggaggaccaccattgagtgaaaagatagcaccattgccatcactaatggaaggagaagaaagcagcttgtacaaagagtttacatggtttgagtacaaaaaatcagctttcaaatctagactagcacaaaacagattaaccctgtttgagaaatttggaacctcatagtggtttttaacgagagacaaagccagaatttaaagtttatcattttatatgtacatatttaatagattcctccgcaaatataccatgtttggatcaaaagggtagtgatatcgaaaaactcaaatgattttcctttgataatataacaatatgttgttcgatcaaactcaaatgtttttatttctaaatgcttcatagatgtctatccttattccttgccttcatcgataaagattcatcccgagttatatttgaccccattattattattttttttaaaaaaattatattacaatttatttaaattcatagttgaaaaatttgtgtatgtgaaccattgatattaaagagattttttttttcctggatagggttatgagatggaatttatgaacaagtttgtgatagcgtgtactatcatcaaccaagttatatatatagtgatgatacttcacatgattattccaactttgttttcacaaaaataacaaagaatgttcttgtatttatgcttatttctcacaatattaaatgtcatcaacaatggaacaaaaagaacatcaccaatgatttgatatttacagcaattctttatttccttcaatcaaatcaactagaattgacaactggaacacatagcaattatgaaaaaggtctgtctatgaaaatgaaggctgtccatgatatttcgaagaaatagtttagtatactaagctttcgttacgtaccataaatcttctcctgtatttttttacatgctattttcacgtctcgaagttttacataaaataaatccagttgaagaaacaatgatatatacaaaaaaaatttattgtttgattcaacttttaggtttgaagagctacgatttgaaaaaaaaaagcatgaattaggtcatcatttttggacgattaggttgatgaggagaagaggaaattagggttctacaaaagaaaagatttacattcaaatatgtaatgggttggatattatctttggagggtcaaattttattttaaaaaatgctaaaagatgaattacgcgcccttcaaagctataccaacacgcgcaggaagctgaagctcgaaaagttgaaaataattcacaccaaacacatgttaaggggtatataaacatcg

SEQ ID NO: 312 - DNA, 3286 bp, Solanum lycopersicum
aacaaaaaaaagataatattcatacagttattcaattatggttagctttcattgaaagtcactcggcaatgataattctcttgggagattggtcaattttcatacttagaaagtcaacaactaacttttatgttatgaaataagttatttatattatattctttgaagcaaaggaagacgaagtttgaatttaaattttatatttataaatatataataagtactttaaaaaaatgacgaatcaatgttataagtaatctcttcccacaaattgaacctagtaagatcttcaagaaattctttgatttcttcttcaaacatgattaatcaatattgtatcttccaacttcactaaaagtgaagcttgaaatttcctagaaggaaaaataagtaaaaaattttaagacgatctaataattaaattattatttttctttaacaatctgctaatataattttaggcggaaccttaaagaattgtttggttgacatatatgataaaaatataacactattttattctacatttataacttagatcattcttttttaattaaattcaaaagaaaaataggttattattcagttagatcatttttttcaaataaactcaaaagaaaatagattattttttttaaagagagaaatattttttaaaaaaacaacaaaatttgtttaggctttcaaagagcattactcataggattaaaatggaaaaatattgattaatcaaatcttaatttattccatggacaagtaattttgaaatatatgatcttaattggaatatttttttgaatataattcttgatttaataagtggactggtagtttggaacatgtgatcttaatttggaaaaagttttaatttagtaaatgaaaaagtaatttgaaatattaaattgatagaaaatattatttgaagtgataaaaaaagggaaaaaaaaaacaacacttcatcacccctataaagtcattcgatttcaacaatattttttttatacatattttttaaagcttagctttttggaaaagaaaatgagatctatgaaccttgttgattcatggggtcaagcttgtctagttatcaatcaatctttaccttacaattcgtttaatggattgatgaaaatcaattcgaaaaatcgaaaaattttgcaacagagtttatcttatagaacattttcatctgtaactgtttcagctattgctaccaatgagaaagttgttatggaaaaagaagaatttaatttcaaggtttacgtagctgaaaaggcgatttgtgtaaataaagctttggatgaggctataatggtaaaagacccacctaagatccatgaagcaatgcgttattcgcttctcgccggcgggaagagagtccggccgatgctctgtcttgctgcctgtgaacttgttgggggaaaccaagggaatgctatggcggctgcttgtgctgttgagatgatacatactatgtctctaattcatgatgatttgccttgtatggatgacgacgatctccgccgtggaaagccgacgaatcataaagtgtacggtgaggatgtggcggtcctcgccggagatgcgctacttgctttcgcattcgagtacctcgctaccgctacaaccggagtttctccgtcgaggatcctcgttgctgtcgccgaattggcgaaatctgttggaactgaagggttagtagctggacaagtagcggatttagcttgtactggtaaccctaatgtgggattagaaatgcttgaattcattcacatacacaaaacggcggcgttgctagaagcttccgttgtaatcggagcaatcctcggcggcggagctgatgaagaagtggataagttaaggagatttgcccaatgcatcggtttattgtttcaggtagttgatgatatccttgacgtgacaaagtcatcgtcggagctcggaaaaaccgccggaaaagatttggcggttgataaaacgacgtatccgaagctgctgggattggaaaaggctaaggaatttgcggcggagctcaacggcgaagctaaacaacagctggcggcgtttgattcacacaaagctgctccattgattgctttagcagattacattgctaatcgtcaaaattaagatttttttgtggaaaatttttagttttatgaagtaattgaatgaatgtagttcttcataatgtgatttgaatcttgatttatcaaatgaaaatgaaaatgaaggtgatatattatattattaataaataaaatcaattttgaatcgtaaattcaattatgaagtatgtttatgttacattcattcacgtattagtaatactttagttattgtattttattttattttgctttaaacctgaagatactttgggcaatatgtattagttaagaaggaacattttgctcaatagcaattgaatacttctgaattttaattttttttctaaattgaatttcaacgcgaaacattttaagtaggaaagtaggctaatttttgttttttgcaattgtgtgtttagatattacataaccaattaagattgttttgtggtatattatgatcaattgaaaattatattgagaattgttcaccttactttctttgttctaagttgtttgtgttttactagaattagctaacgtttaaaatggaaaatgtttgtgttttctacgttttctatgttctaaattgtttgttatgaattcggttttcatctattttaaaagaataaatttttttttcttgttttagcaatattttactgatgtgttatgttaaaatgttatttacgttacattcatgcacgcacttgtaattcatgatttaattacttatatattaattattgtatttttttatctaaaacacgaagatactttaaacaacaagtatatgttaaaaaggagcatgttgctccttcctgatttcttcctaactagcaatcgaacaacttttgaatttgattcttctttaaatttaagcataaacataaaatgttttaaatacagcataaaccaatcaatattatttagtattttattagaatcaaatgaagcctatattgaaaaatgttagtgctttctttatgtttttcttatttatttttttaaaaaataaaataaaatttaacaactctttattttcaattttcgaaggtgatttagatgcgtgttgtattcaattttggttcctcgtagaaaatgaaagaccaccattggctgtatgtacaaaagaagtaaattaattggaatggaatctgaatcacatgtaatac

SEQ ID NO: 313 - DNA, 6416 bp, Solanum lycopersicum
aaaagtattcttttactttatgtgattggatatttttctcaaggagtgtgtcaagctttaactatccacttaatattaacctcaatgacatattattttattttttaccgcattgatttttctcattataacaaaatttttagcaacaataaaatatatattaataaagtgtattaaagtatttatgaatattaattgattttcattaattttatcgtcattatacacttaaaagtatttacaaaaagtgttaaattatcgctaaaaaatcatatcgaacggtaaataaatttttatcattgattaattattgctaaaaattatttttaatgcagaaaatttctatatgtgttgagttaagataaagatagaaaactacaacaatcattaattatatctcttaatattcttttgtaacaactatttcatagcacgataattgaaatagatcggagagaaaaagtataggttagaataatgttaaaatgtaattaaagcaaacacatgttgagtgtacaaaataatcaaataaatgacaatatccttttctttttcaaccattacaacagatatagatgagctcataatacatgtaaatccacttccaacataaccctaccatgtctcatttcaacttgcaagcctttcatatccctttagccctctctcaattaaatactaaaagaaatcttagctattaaaacagctcacgagcacttttcaaaatagattttttttttctatcttcaaaaaaagaacatccacaaacccctttaatactatatatttttaaattattattttttctctctttctttttctatatacaaagtataagacaaaacaaaaagaaaattacaaattctttacacaaattgtggtgtagaataaatctttcactctccacgctccccccacttataacaacaacaaaaaggaaataaaatgacatttctctatatcaaatataaatatttaaaaaaaacaaaccattttgggtatattactctctattccactatcaaaaaatattctaaccatttccctagcttagagtttactaagcttataataattctttcctctttatctctctttttgtgctccaatttagggcatgcaaggctaaatctacaaggcaaaattcaaaaattcaaaaattcgatatacgtatttattataatgctagttgtgtcaccttttagtaacacaacggcgagagatgaaagaggtaatgagatggaaagtttcgcgataggaggaggtggaggtggaggagatgattttcccgattttatgggggagaatttactcgatagcatcgattttgacgacctttttgttgggattaatgatggagatgtacttcccgatttggaaatggatactgaaatcctcgcagaattttccgtaagcagtggtgatgagtctgatgtaaacaattatagcagtagtaataataataatacttttattactactgctatcaaaaatgtagaaagaaaagaagaaattgaaaaaacaggctcggtttcagcttcggatgtaggttcgggtttaacaacgagcctaaatcaaggagaagaaattgttagtactcaaaaaagtgaagaatctacgcaacaaaggaatcagaatatagttacccctaaagaaagtgataaaggtaaaaagtcatccaagaatcataatcttccaggcaagaggaaagtaaaggtcagtataaacaatttttacattatcggttcattctcgtggatgtctaatgttatatcgacttgatgaattaactaagtattaaatcgatgaaattaatatatatttttttattgaatcgtgtgaaggtggactggacaccagaattgcacagaagatttgtacaagctgtagagcaactaggtgtagataaggcagtcccatcaagaattttggagattatgggaattgattgtctcactcgtcataatattgcaagtcatcttcaagtatgaaaaaaatatattttaaatttttattaattttcgaaatttattttaataaaatatggttttgtagatttggtttagtaatgatgccaaatgaaatggtccttaaatagtcgttccattgtatttggaaaaaagaataatattagacaatgatgaaaactgaaaaagtagtactaatagttttattttgcattgttctttaccccaaatggtattatattatatagtttttaaaaaagtaaaatagatctgatgatttgaaaattggaaagtacttgaaagaggaaacattttaggtaccaaaaagtgtatatttgagtttaaatttaatgtgttttattcggaattatcaatagttttaattatcattagatctgaacatatgaaataattgatgaaaaatgtgcagaaatatcggtcccataggaaacatttgcttgcaagagaagtggaggcagcgagttggagccacaggaggcaactctatggaggtgcccctatggttggagggggcggaggaaagagagagatgaatccgtggcctgcaccaaccattgggtttccacctcctcctcctcttccgccccctgtggcacctccaatgcctcatcattttagacccttacaggtatggggtcatccatctgtcgaccaatcatatatgcacatgtggcctaaacatctagcaccttcgccgtctccacaacatccatcaccagcatgggctcctcctcctcatcatcttcatcctccacctcctttggatccttctttttggcatccacatcatcaacgggtgagtttttttaagttaattatattctcaacacgtttttttaatttgattatattcttttagtaatgattagtaacaggagactcgaatccaagacatttatatgctctagttcttaagtgtctctgaagtgtgtgaatatctcgtctaaaatatataagtactagatagatctagtatttacgtatctcggagaaagagaaacagaaagagagagagcgttatacgtagaaagcatgctccctcccttaaataacttaaacttttagatgagatagttacacatttcaaaatgatatcaaagcagacaagagcttaaacttttaaatgagatggtcgcacacttcaacaacaatcccatctcgataacgtatattttggagctccatatatgacattcaataatcaaataacttgaacaaacaatagtgaaaatagtagttttagttacaacaagtttgacataaaaaacgtttatgtcaatatgtaaagaattaataattgtgttttgattgtatgtatgactatatgataaattctccttttgtattattgtgcaggtacaaaattctcttacaccaggaactccttactttccagcaccaacggtaactatattttcaatcaatttatcattattcttttgaaccttaactaattcgaaataatgttacataagacttattaatcttaagattcgaatcagaagattctggttaagttagtgtttgactatatttagatttagttgaattgcgaaaaaaataattgaagtttgttgagaaaataggttttgcattttgaaattgtgtttgaatgtaaacattttactgattaattactttagaaattacgtagaccatgtgtgtggtgtttttttttggcatatatctattttgcaagtttatttttggctttatatagtctgaacaaaataattatggtgcagagatatccggtaccaggcataccacccgtatcgtcgcatggtatgtacaaagtagatcaatctaatattggagttcgaagtaccgctactctcccagcacaacctctacctgaacctccatgcgactttcatcctgtatgtccttctctcgataattttatttttttgacgtaatatataaatatgctttttaatttgacttcagaattcaacaaacatttatgtcatttaattttgaaagtgcataggtagacacgcttcctacaaaatgcctacttattcaactttataccacttaagtgtttcgttatgcacatcaaatgttagaaggcataaatgttaccgagagtcaagttaaaaaacacatttatatattacgtctttcttttcgttttgtacatgaaatttgtccttatcgaaaacccttttttatatagaattcatgcattgtacaaattgctaaaagtcattaagaaaaagtaccacaattcttacaacggccagttttagcacaacttatatatatatctacgcaattcgtttgaggaatttttaacttgttatatgccaaacaaaatgagttatataatttttttagggacattttcgacctcttgtgacacaaccttataatatgcgcatgaacatacacagagtcgaagctaaatggggttcatgaattcgacgaattcactaactttttcgtagaccatatatttttattaaaaaattatataaatatatgtatgtattaacatgtgaaaccactaagaaaattaattttgaacctcaaaactcctaactttgtctccacctctaattacaagcatatattataactacatataattgtccataataaatgagatttaacaacctgaaaaataaggttagttaaataatcttctataacatgttaaaataaacttatatatagtataaaattatttacattacttatcagcatataaaacttagatttcttaagatctttattatcccatgtaggtcattattgttgaactatacgtgtcattatattattagtgctcatgttcaagttagtttttttttcaatatttattcaagtttaatttatcgacaagttatctatggacagtcaaaggagagcatagatgcagccattggagatgttttatcaaagccatggctaccacttcccctaggactcaaacctccggccgtcgatagcgtgctcggtgaattacaacgtcaaggggtacctaaaataccaccaacttgtgcatagttgtttttaatgaggcagctagcaatgcgcgggtggatttttttggatatacttagggcacgtaactaagtagcccttcaattcgacgatatttcttgcacttatttagatgcatgaatgaagatgatcaattcgatgtggatcgtatatcatcgtcaacatcataatctaaattaatgcagtttttttttacctcaaatatatatataagaaaacttttaattaattcgttgtcctacttgatttgttcttgttttgctatgtacaagaacatgtattaacttaactgttgggtttttttgtgatgatgttatcaccggtttgagaaatatcattataataatagcaagagcttcttgtaattaaacttgtttatctcttctttaattaattccttagtgtgttattcaatattcctcttcttattttttgtttttccacccccgatgtccgggttcatattagagctttgattaaattcgaattgtgtgctgcagggtttatttgggggtgacacttccaataggattttctccatacccagagctcgaacctgaaacctcctgtaaaagagtgaaacacttctaccgatgcgcacaattataatcaatgttgctcttgttcctcatcgattgggtaaatatttgtaaaaaaagggtttaaagtgatcacacggttcatattgtttattaaataccaaggaattaaatgaagccatcacgcaattcaacatggtctaactttgattatattcactgtaggagttacgattgatctgatattcattggtcactcacctaatagtaactttttttattgaaagaaattagaaaaaaaaatgataattatcgaaaatatataatacaattgttaattgagtgatcatacaagaaatcaacctcgtgaaagaggcaagcatacaatgaacgaaagatttagtttgttgaaaaaaataagttctccatcaatctttacgaataattattcaagaaaacaaaagttaaaagaacataaaaattagttgatatgtttaagttattccatgcatgaatacgactgagtaattaatttgatttcataaagtccttcaaattaagcacccttagttaaccaacttttagaggcatttctcattcacatggagctattaataattatgattatagttacatagaaaataaaaaggaaccttagaaaaaacaagaacagcatatgaccaccataatatttttgtttttttccctctcacagcaaaggattttgatttttcatcaataatataagcaaaagatttcatagaaatagtggttctaagttgatgttccttcctgttaattattccttccgtccggccgtggttattcactatactatttcaaaatgttcaacaatatttgttgactttataaaatc

SEQ ID NO: 314 - DNA, 6719 bp, Solanum lycopersicum
ctttgaaattcgatataattagccctcaaatgtatgaaatttctctattttatgctaacctcttaaatgcttagaaaatgactcaatagagggtaattttgaaactttaatttgagtttttaagattcaagttttcatttaaaaaacaacaatagcttattaactttatatacttttttcccttttgtctcaaataatatctacataaaatacgcataaactatatattattattattattattattattattatttatggtagtatagaaatatacattctaaaatgaaaatacaaatatcaataataaataaattaaaaacattgaaattatagaaccaaccttttaaatagtaaaaaatatactatattttattttgttcaagaaaatttcaatcatctcgtatcaaccctactaataaagaaatgagaatggtaaccttattatgaatttttgcatcaatagttgaaaatatttactgatcattttcactaatcgatacacataaaatattttaagttattggataacgattatttatgttaattcttttaaattatttaattttagaactgcaacttaaaattatttatttaaaacataaaatatatatcttaatcatttcacctcaatttaataaagacatcaacttaaacctacatccttttgttctcatcttaatcaaatgaataaaaaacacaaaagctactcataaaacagctcacaaactcttgtacagtaatagattttttatatatccaaaaaaaggccatccacaaaacttttaaatattaaaattttaattcaagaacaagccaaaatcaaaaacaaaaaaaacaaaaaatagacacacacccctcttatacaagttgtggtggaaattaaatattttaatcttatacacagctccttataacttatatatatatatatattactcccaacaaaaaaaaaatgaaacaagaaagaatcaattttaatttaagttccaatccaaaacttatattttctctcttttgatgtcaccaaattcttcatcctatattcatcaagagagggtaaattgagttgtttttacttttaagattacgaattttatattttaagaaggtttatttatcgatatctttgagcgatttcattgcctgttatagcaggtaatttgtcttattttttattacaaattttagagtttttaaaagatttatctatcgatatttgagtgagttgtagcagatagcctatcttattatcgaaattacaaatctcatattatgaggaagcttagttgtcaaaatgtttcatgaatgagttaattatatgttgtagcaaataatttatcttatttttaacattacaaatttaagagttttaaggaatgaattatagcaggtaatctatcttattttcgaaattacaaatctcatattatgaggaagcttacatgttgatgttctttgaatgagttgattatctgttgtagcaggtaatttgtcttattttcaacattacaaaaatttaagagtttaaggagagacttatctacacatttaactaatttataacagataatttatcttatttttaaaattacgaatctcattttacgaaaaggcttgcttgtctatattctttgaataattgattatctgttatatcgagtaatttaggttgattctcaatattacaaatctcacattttaagatgctggcatttgtgtgattcttatcttttagtgacttgttatagcatgtaatcttatcttacttttaatattactaattaatcttacatttttattttcttgaaggttaattatacttatagtatttgaaataatgcttgctctatcttcatcattgagctacaaaaatgaaagggaaaattatgatttattccaagatttttcccatgggaatttaatcgacaccatcaatttcgatgactttttcgatgaaatcaacggtggagatttactgccagatttcgaaattttttgtgaagaacctgctattcatggaaatatgaaatctaagtcaaaagaagctaaaaaaatcatctagcaaaatcaaaaatcctcaaggaaagaaaaaagtaaaggtaaactttttttcttattattaattataatttatattcatcgttatcgtaaaaaatctaattatcgttgacggttctagtcgtaattaagattataaatttcatgtgttaaaagaactaagtagtaatatttgtcgatatcctttttaagtgtcttgatgattacctctcatatagaagataataatttgtctttatcttttaagattaaaaaattattttaagtgtctaatgcagtgtcggattcagaattttcattaaagggatttaaaaaaaatttagtgattcgaactcctaaatcactaagtcaaactctaatcttttatttaggaagttcaaaatcaatatataaacatacaaattctttaaaatacctcagatatacaacgtaatttttttatcgaagagattcgaatgaacccctcgcccctcggcatactctaggtctgctcctagtctaatgatagcttaaataaacttgtaatgttattcatgcaaagtaaacatcatcaacgatttaattttttctcaaaaatttaagttatatatgttgatatgacaaaataatgaattttttaatggataagttataggttaatgttttacttacttatttgtttgtttatttaatttttgtttttttattaataaaatggaagtttaatttcttgaattatgtgaagttggattggactccagagctacataggaaatttgtaaaagcaatagagaaattaggtgttgataaggcagtcccatcaagaattttggagcttatggcaactcatggtctcactagacataacattgctagtcatcttcaagtaagtttcatccgtgagattttcgaattcgagttttagatataaaattatttattatatttaatttatatgatatttttcattttttcagaacgaaatttatgtatatatagactatgtaaaaagtgttatacagtgacaataattaataatttaaaatactttaaagacatatgaacaacttttagtcaaagaataacttgttctcttgaaatttgaatatcgccatttttgcaatttgggagtactctccatgatatgagagttttcaacaagaatcaaaatcaattacgaatatcgaacatcaaaaaaaaagaaaaaacttattcaattagttttgattgaaacgattttcaaatttatatctcatttaaattttattgtatgagttaattttattttatataggtatgtattattaaattaacgtcaggtacaataaatcttcaagataagcataatatgataacataaaaagaaaaaatcaactataataagttatattgacttgatggtgtaagaattgtgcacattttttactatatgtaatttaaattcttgttatatatgtgaagaaatatcgagctcatcgaaaacatttactagcgagagaagctgaagcagcgagcttgaaccataggaagcaaatgtatagcggagccaccacaatcggaggcggaggaaagagaattttgatgaacccctggcccgcaccgccaaccatgggtttcccacccatggctcatcatgttagacccttacatgtttgggggcatccacatgtaaataattcattttggcatccacattatcaaagggtgagtcatttttttattttcgatttactcaattctaatctgactcaatatataattctaagttaaaaataaaattttaaaaaagttgtaattgaccatgacatatttaacatttgtatgtttataatactttttttaaaattattataatatttgtgtgattaatatatattcataagaagtattataaatttcatcatgttcaattaaataatgctatataaattgaaatatattttgtaggtatcgaattctcttgtaccaggcactccttgtttttctgcgccaataacatcagcggtaactattttatcgaataattattactaatatttaatagatgtttgatcatacaatttgtgaagagaaaattttatttaaaattttgtaaccaaaactaaaattcttttattttataataaatataataaatgtgatttaataatataaaaattgcttctttttttgttttttgacttatatagacaaaataatttgatgcagagatttgcagcacctctcatggtcccaggcatcccaccaagccctgccatcatcaaagttgacacagttgcctctgatttgcaccccgtgagccttctttctattccgatttatcgtcacataaatattttatcgctctattcatatcataagtttttaaaagtcatatatgcaaataggaaaagggtctgatataccccttaattttatcatttagagctgatatgccctttgttatgaaagtgactcatatatacccctacttgtaaacaaatggctcacatatacccttttcctctaacggaaatgaaaaaaataatacttttaatctaaatttttattatttttttctaaaaaatataatcccgtatgagtaaatttaatcctcgtcaaatatattttttttgactttttttgtttcaatgactaatttataattatattttgataatcaaatttatttatgtttcactaatattcttgtaaaacttattatagatgaccaaattttttcttcgaatacgaaattaaattacaatacacacaaaaaaaattgtttaattttttattctttaaattaaggaatgaaagaaaaaacaaaataagaataagaaattcaaataattataataaaagaaaacaagaaataatttatgtatgaaaaaaattaaaatataccttgaactttgaaagaagaatcatatatacccctaaataatttttaaaaaaattagaagtaataaatataaatttaaaactaattttttaacttccgttaaatgaagggtatttgtgagccattttataacggcaggggtatatgtgagccgtttgtataacggtaagggcatatatgagccacttttataacaagggatatatcagctccaaatgacaaagttgaggggtatatcagactcttttccctatgcaaatttagacattctaacctggtttgattgtgtcatttgaatactatttcaacatataaaataattatctagacgtacattttcataattcatatgtcacatcaatatcgaatatttcgtaagacactgtagaaataagttagagtgtgttcacttgtcagttgagatcaattgagatatctaaatacactacgctcttaatgttggagtgcctacttattaactagcgtgtgctcacgcattaagccaggtaaaatctttccttttttttttagtcaaaatttttcactaaaaaatttcatcttaaaaaatttaacctcttatatacaatataatttttttataaattaattttttccccgatttctgacatattatcttgatgttgttaacagtcaaatgagagcatagatgcagctattgaagatgttttatcaaagccacaattgccacttcccataggactcaaacctccatcaattgacagtgtgttgaatgaattacaacgtcaagggattaccaaaatacccccaacttgattttataataatttcgagttttttttatcatgaattttctattaaaaaaaataacttaaattcgacgatatttcttgcacttgatgtatcaacaatgaagaaaagaagaaaagaaaaaaaaagtattcaaaggtctttgttatgtaacacgtgagataagaattataatttcaaaacatattttatatgaaataaaatactaataatcaatcctatgaaatatttcactatattagtaactttttaggtttgtgatacttttttgttcttgtgtctggttgggacaataacaattactgaacttaacaagggccacacatgcatggagtggtcaatttatgccacactattctgttattcagagtgtcaaaagaatatgaaaaatcaattgaaaatgattgaaatcaaattgatttaataaaattgtagatttgtattctaagtatataatcgtttcgaacaattgagatgatctttttaagttatgaaaaaactaaaagaatttgaattgaaccaaataatcttagatatatgtaaatatatttatacattaacagcgacatgttaagtttaatatataaatatatttttaaaatatttttcaaatataaatataatttaggtcctacgcttctggtgactatgcgactttgagtctttgctttttcattagcttttacttaattatgttgaaaattaaaagatattgtaatagatactctatcaaacaatacaaaaaaaatctatcaaaacacttctattaaatatttaatatcaaacaatacgacaacttaagattttacattcttatctttttgatgaagaattaaagtgtttcttcaagatataaccaaatcgtatcgataccgataccaaagagaaaccaatatgattaggatgattttaaaaagtctaattttaattatatattataaaatatctaaatattgagatgatataactttttaaaagtactcgataaaatcgtaccattgacgtc

SEQ ID NO: 315 - DNA, 5516 bp, Solanum lycopersicum
atacatataaaatttcagttgactttttgtaaaaattactcatagatttactttatattccttatttttatgttaataataataaaacaattacatattatcgtagtatttgagtttgtccaagtgttaaaaataataataataacaaaaaaaaatatttgttttttcgtaaaatttgatcacaaactctctaaacttcacttttttccccattcaaaagaataaacacttccccttcatcggacggtgtttatgcagacattgtgtcatttgaaatatcgaaattttttaaaaaattataaaatatattatcaattactttttaacaaatataataacaatggtatatcaatgtaattttataaacaaaacttaaaaaaaagatatatgtttatatataattttcgatatatactttttctttaacaaataaccaaaatatcttttattcttttttggttcctaagaaaacttattcatggcactaggaattccatgtcaaccattttgcacatcacaataattatatatattatatatatatatattttttttatatatatataaaaaaattattaatagcgccacacaaaatacaattaagaaaacgtaaaggacttaaacgacgtcgtactcattcaattcctttactgttacgaaatcatttctcgattaacaaataaataattacttcgttcatctttacttattcatatttgatttaatataattttttaaacataaattaataatatcatttctatggtaaaaatataaattataattgatatattatagtttttaatataatgaatgagtaaaaatagacgcttattcatatttgatttaatataattttttaaacataaattaataatatcatttctatggagtgtaaaaatataaattataattgatatattatagtttttaatataatgaacgagtaaaaatagacggtagcgaataattataaaaacttatccatggaggaaggactccaagaacttttagccattgcactgtaaacgccattgaaatttgaaaaacttcccataaattccattaaaaaacaatcatttttatattcatttttctacatatttcatcatatagatacactgattgttgtatctattagcttttgcttgtaagaaacccttatacacattaaagaatactataaagattcaattttgtatagcaatcatcacttctttcttgttctaatccattcaagaagaaggttaatctgtccttttcacttctctttttttttcaaataccctttgttcaagactcttcctttaagatggcttctatatcacccttatctcaatctcaaccccttttggagaaacctcagtttacagttttgaacaagtctcaaaatcagtttttttcaatacccttttcaagattcactcaaagttgtaatctttctttgaaaaaatcaaggatggtggttgtttcagcaacaactgctgctgagaaatcaaataagaggtatcctggtgaggctaaggggtttgtggaggaaatgaggtttgtggctatgaagttgcatactaaggaccaggctaaggaaggggaaaaagagcctgtagatcagcctttggccaagtgggagcctagtgttgaagggtacttgaagttcttggtggatagcaaattggtttatgatactttggaaagaattgtggaaaaggctccttttcctgagtgtgagtttttcttaatttatgtgcatctgttagtgttgtaatatgttgttttgtttggttcatggtattgacaattgaataacttgactgattggttctgctttggggtgttttgtttggttcatgggtattgacaattgaaccatttgactgattggttcagctgtgtgtgtgtgtgtggggggggggggggattagtatgttatactcttttaactgtggaattttgagatgagtttttcaattctgttggtacctatgctgcttttttgtcattgattctttgatatccattaaggttctaatatattgttttgtttggttcatgctattgataattgaaaacgcttgatggattcctccttttgtgggaatatattatactctttaatcagttgaggagtagtctctgatcctcattttcttttgtgtaaacagaaagttcccagttgtatagaaaatcatgcttagtagattctttactttttggtatattacatgtatatggccagtttgaccatgtttatgaatgaatatactatacttgcacttgatcaaaaaaataatttactctttaaactttggagatcattgtggaaaaggtttgttggtttctattggtatttctgagcaacatggtagttgataattgatgattttattatcatcgagttgtgatcttcggttcccaaacaagtagatgttgaaattcattccataagctgtaactcaatagtgagctaacaaagacatgtaaagggatatggtagaatttgtcttctggatgatagagaagctcagttgtgagagaagaactgatttgctgatgttgttttgaaccaatcagttgaatttcagctctaactaatgaccccagggctgatctgctacgcttcctttttctttccctttggttgtttcagctttatgtttagtaatgctttttcaccaacggagttcacaacatgaataagttaacttgctttacatacaaagtactttgcttttcttttacggcaaaggcatgtgatctgtgcctttccaagcacactctccacatagatgcataaataaatgagttggtagtaaaacagaatcttagaactcttacatttgactgcagatgctgagttcaggaatacaggattagaaaggtctgaggttctagcaaaggatttggaatggtttaggcagcagggtcatgccatcccggaaccatcaactcctggtgtcacctatgctagttacttagaggagctatcagaaaaggatcctcaagcatttatttgccatttttacaacacctactttgctcattcagctggaggccgcatgatagggaaaaaggtcagtgatctcttcttttaagtttttagtattatttcacattgttagtctgatactgtggtgtataaaggtagaattttatcatagaaatatggaatgaacaaaagcttagatggttctaagtcacaattcgaagggtaccctctgatgacacccaaagatgtgactttgacacttagttggtcaatgaggtgggaggagaaccatccatttaagccttagtgagcagagttacctagtacggtgctagtgagaggtagcaggtactcagtgtaatagcgaggtgcatccgaggcaactcatgtggagatgacattatttttggttctcaataaactcaagtcattacacccttttattgattcatatctcttcccctctttgtattctgttttctgtttgccacttgaggtgcgttacataggccttaaaattttcgtaataccatttttctctgtttaccatacttccattcatccactcattagtacttcaaatttgatggatagttgaaatgttataagttcctatctttatcatcgcttagtctcaaaatgacaaaatcaactcaagtctatgattactgtaacaaataaactaaacaacgttgtaaagatgaaaatttgagctttcatcagtgttaaaaatgctcgtcagatgataaattcagattagaagaaatgtaaaaaaggaggcaatcctatactgtggttacgaattcctctgttagactagtactgtggtagaggttgttgtctccctattgcatagtttttgttcctttccttcttcccttcttagagctatgaatgtttacaaggaaaaaggcagttacttgtcgacaatcatgctgcttcttcctttataggtagctgaaaaggtacttgacaagaaagagctggaattctacaaatgggacggcgatctttctcagctgctgcagaatgttagggataagctgaacaaagttgcagaagtaaaatcattagctttccctttacaagttttcaactttttaaaactataatcatttctttcaccttactcgtttccattgatggggttaacgacttaacatgatccattttcgattcttttgctcagaactggactagagaggagaagaatcattgtctggaagagacagagaagtcattcaagttctccggggccattctccgtttgatattttcttgatgcacaactttgcgctttgtttcctcgttttaacttgtacattggatggttgaaaggtcaaatttctttgaatatttgtgttccttttcactttctttctgtctatgttgtgtaagaacttgattataaataagtgctacatcattattcaacactcaaaagttgctgctgctcaactaccaagatgtttaaggcccaatttgttctaatgccaaatcatgttatagatcaaaaggcttgttgaaaaacttatacatccttttaattttgttttttgtttctctggttttgacttgatatgaaatctaagaattaaagaagacttttgaattgcgtagccaaaaaaaaatgcaaatgagtacatattcaaaagaacaacaattaaagataattatgatgttcggatcagcttatgtatatcttgactacttctcctggatctcatatctcactgataatgccttagcaacagttaatattggtctgcaatagcacaatgttcattcagataaaactccaataatgaaataagataagcaaatgataaaaaaaaatcaaaattctgaagtcttcaatcctcagctaacatcagtctgaatcagaatcactgtaagtctgatataagcaaagttgagtccatttcgttcatgttctgaattgttgtatagtttcaaatacaattattgtactaacctggatcgttgtcagaacgaacctccacaggtttgtttcctatgtattcgtgctcttcttgaattcggccagcagaagccatgagttttgcactacagttctgtaactcgattagttgtagcgagtaaatatcagcaaactcagcagggatctcctccaaatgaaagcaatgtctgatcacgagatgctcaaggacagggaaatgatcatcagtggctttccagtacttgagatttgtaccttcgataagcaaaagcttcaattgaggaaatcccccttcaatgggataccattctgtgccatgacaagcatctggtttcagcttcagcacctccaggttaggacacttacctataatgttcaagtcctcccatgctagacgagttccgactagttttaacttcttgagcttagttggaaaatgttcagcactaggtacatagacaggagatctctggaatctcaaatccgagcgtcttacctgaaaccaatcaactttgatactcaatgtttctagctgatgtagatcagcaagactatgaaagttcatatctt

SEQ ID NO: 316 - DNA, 4782 bp, Solanum lycopersicum
cctaatagttcaaaatattattttactcgttaccttaattatttgaacatagccaaacctcttatcctagaataattaaagataatttaataaatttataaattacaatacagtatgatacaatcaaaccaaacaattaaaatcttattaaataacaacaaaaatacaatttaactaaatattatatctaccatacaatacagtataatatagtacaatatattataaaataatgaataataatgatacaaacaaaaaaagcgtaaattaagcatatgataagatcaaattataacccaacaagatataaaaatccagctcataaactttagcaagtgtcaacaaatcatttatcaaggtaattgaagacaaaagcaacccattccccaccacctaatttaatatgccatatattattactctttttagcacaaacacacccttctacatttcattcaattgttatttctttgtctccttttatttttcacaatagatagtttcttttttggtagccactagcttgctagtaatttagtattcttttcgttttattttatatgatataatttttttaattttcatttatttcttaaaagtatttttaaactatttaaaaataacttaatttatcctcccttaaaataaaaaaggttgattaattttattcttaaattattcaaaatagcataattttatcttgttttctagaatacattttatataaactaaaagtctttcttcctagacgcaagatatacattaaaaataatgctacattatataaatattattttatgaggtttggatgaatcctttgctccctcgattttttattttgtgtatagtcaaatattgttatataaaataaaggagtggggtaacaattaaataaacccaatctagttgctagtttatctcctttctctccaccctatatatttttaactctcacttttctatctcaaaccaaaagtactcttaaaaaaaataacaaaaaatgagtagtaataagttggattttgaggagacagaattaaggctagggttgcctggtggagcaagaaaaaatgtttatggtgataatgatacttgtaatgttaatggtaaaagaggctttgtagatttgaagcttaatctttcttctgatattaacaacatcaagaattcaacacacaaaaccccagctgccaagtatgtgtctttaaattgtatctttttctacttttccaaaaaacaaaaaaaagtatataagtaaagaaacgttaggtgatttctgtccatctattcgaattttcataaacattaagtattcacgttggtgtgaaaaaatagagagtcagaatttttgagtttatgaatttagagtattttagaaaatataactatttagtaggttttggagaaattttctataaacattatgtgaatgtttcgagtataaatatagagtttatattgaatttactcatgagcttttcgaatttataagcagaactgtaattctgtccttggatttatgagaggtagataggtaatcatggaatagatagagtttcaaataaactttttatcgatgtattgtgttcatttcctatatagttaagactctttaaaaataatgttatattcatattaaatttttcaaaaaataccctgaacacataattagtaatgtttccttaagaattcgttcatataaacttatattatcattgtatatgattcctttgaatttataaattcaaattatcagggcacaagttgtgggttggccgcccgtaaggtcctttcgaaagaatattttgacttctcaaaagcttgatcgagagaatgataatattttggtgaaggtgagcatggatggtgcaccttaccttaggaaagtggacttaaacatgtacaagagttatcaagaattatttgatgccttaaccaagatgttcaattccttcactattggtatgacatatttactttttatatttcctatgaatttaaccctttatcatgaacaaatttaacattttaagtttatagatccaacaattaagttttagatgaataattgatttcttcatatatgtataggccaaaactactcgtattatttgctaaattcgtaactgatactttaactagtttcacttatataatttatataccccgagaatacaaaaataattacactttaagataagtacaaaaagtgaattttagttatattatattatttgtagttgcacgaagtcatctttgtccaaaagaagttaattaacacttttttattgaaaaattatgttatgcgaatagttcagagctcaatttatttttattttaatatatgttatactatattattttgattttcttagatttttcgatgtttatattttcttttatattttgaatttttccattaaaattttattttttaccaacgctttgatcacctaaaaaataaccataaacaattgtttattgaggttaaactaatcacgtgaaaatattaaagataacctatacagaataagtgctaaattatattaataaatcataaacatggaacttcatcaactccaacacaatttttatattcttttggagctaacataacaaactacgcgagtctcccagtgaagccaacataaattcaaattgaacaaaaaataaaaggaagtttaactattctggtataccaaaccacttgttttgaaacttaatgttctaatcaaagcatataaattgataaataaatttatatgtcagcgtatataaattaaatttttattttttgatatcttataacttgtatgtatatgttttattactgactaaaatggaactgtgaaatagtccaaggaatgaaagatttcatgcatgaggggaaactgatggaccttttgaatagttctgattatgttcctacctatgaagacaaagatggtgattggatgcttgttggagatgtcccatgggggtaagactttgacacctcaactatataatatatttaaaaaaatgttttatatgtattcaatggtataaaaaatagttatagtttaagttatttataaggtagataataattgattatgatatgataaagattttaattaacttactatcgcatgttaaattatattaatggcgtatataaaagtgttttttttattgtgaacatgctttttttaatataaatttatttgtcactataccttataacatagtacatgtattgtctccttcggcctaatagagcttacatatttatcctttgttttatgctattatcgaaattataaatgtgtatatgtatcatgtaaatttatattattctttataaaatttttcagttttctctgtcatttcaatgtgaaattctcccgaggcatgttatctgcaccctttttcaaaagtttatcaacctaaaaatctatctcgattcatctgtgacccgtcctccatcatgggcatgacactatactttcattaaacaggatgtttgttgattcttgcaaacgcttgcgcatcatgaaaggaactgaagcaataggactaggtatgatatatgatgtatgatatatattactcattaattaattactattttattgttatttattttatctttggattaatttgtttcaaaactgttctagttaattaatcaaatagcttactttgagtattgttgatattgatcataacattgaattattttccgaatttaatattcagcaccaagggctatggagaagtgcaagaacagaaatggatgaaatcaagttaacctttttaaatgaatttcatcaatcaaaatttcatcgattatagtaaatgtttattcgaattgaatagtgtgttatgtattaatgctgctattataaagtgcttgtatgtattaataatgagtgtagcatatttatttctgtaaatgtaatttatttagtgctataatatttcttatttaatacaactcgataaatcgtttgtctaataataatttagtttaagttgcttaatgcattggtgttattgtattatattcttttgttaataatgtaggcatttattccccaacgtatagggaacatattcatgtgcaatgtctaccaatcctaccatatattttatgtattatatgaacaaaataattgtatgatttgaatattcaatgtgctttttttcattatttttgccattatattttcgggaaccacattgcactattgaggaacctaatattctaaatattagggtaacttaaataaatcttaatagtttatgaggtatttattaaatatattagttaataatattataaatttaattaatttttgttgtgttcaaatacgtctaaatatatgaggttaaaattaattatgtgcaggtggattaatatgtatctgcgatacatagacaaatattgttcgctattctcttatttcgttcgcgtatttggtatctcaaatacatgtgaaatcacaccagatacatgtgaaatcaaacataatacatatatctagtgtgattcgcaagtatctgaaatatatagataaatcttcctcgccttccttatgttcttgcccacctctttctccatttcagtgaatctgataacaaaaattataaatctaaatatatttaattttgaattaatcttatatggcgagataaactataattattttatgtaatttgatagtttcacctaaatattatcctttgtagggtaggtagttttgccaccacgttcacgagaattagtggctttatttg

SEQ ID NO: 317 - DNA, 14147 bp, Solanum lycopersicum
cttatagttttacttaattttgctattagattgatttgtacaattcgtcttataagtataaaatttaaaatttgtataattttatttttgattatataaatcaagaattttatgtatgtttgtcctaactatttgtatataatttataaaaaaattgataataaattgtcttgtttgtatactgagaaacgaaatatacaaacaaatttctgaaaaaattctgaccgtataaatacagaatttatatatatttaacgtatttatatattcgcaagtgaaacttataagcagacataaatatgcataccaacataaatatacaaacctcaatcttaatagcaaataaatataaatataaaacacaattatcgaaactataagtctaaaatcttaatatatctattttatttgctattagtaagatcatgagggggaggcagatgtgagttatgaggattcactagctttgactaaattgttaaatagttaataagtatacgtaacaaatttgtgtacttagtaggcgtttaattatagaacatttttttaagaaaataaaaatttctttatttaagtttttcaaaaaaaaaatcatctcttaaaatttgtaaaagaattcatatttgacgtgaaaagattattacgtcatatcagggaattaaagaataaccagtttaaattatattattgtttatttattgactagcggatatttatttaattatattctcagtattattttatatgacatcatttttttagttgatctcaaaaaaatgttaccttacttcacacaaatattcaagatttatattaaactacaagtttccaaaaaataaaaataattcttaaaaataaaaaatgtgtcacataaaatgaaacatatatatttaaacatttatatgtgacttatcaatttgagttgggttatatgaaagtgacaaacgattagatagggcataacagtgcttctctctctttccattaaatttggtagtccacatacagagagagtagaaaaagtgtgttaacctagagtggaataatagtgtttttcttgttagagacaagaaaagagagaaaaatgggaagaggaagagtagaactaaagagaatagagaacaaaataaacaggcaagttacttttgctaagagaagaaatggacttcttaagaaagcttatgagttatctatactttgtgatgctgaagttgctctcatcatcttctctagccgcggaaaactctatgagttttcaagtgcttccaggtatatatatatatacatatgtttttcttctttttgtgtgtgcgtatgtgtttacttactttcattaattaactcaaccatatatatacatctctcacctcaattatatatatgtttgagatctgaatgtctacggactccatttaggtacatatctttgtttagatcataaatcatctatcttcattcctaagatctactaatatatatgtataagaagatccatccatctattaggtttttcaacaacatatacagtgaaatcttatatgtgggcccacgtatagccatatgagaaaatagtgtgcacgtaaacattatcattacttaattataggaatatacatccattaggtttatcaacaacaataaaatcctctaaatggagtctagtcataggtctagccgtttgaaaatgtaaaatatatgccgatcttatcactatgtcataataatagatatgttgttattgaaagattctcaatctttttttttcttcaaggtagagattcttaagtggattcatgttttttttatcaaaaaagaaaaaaacaaaagtgtccatttgttcatctaatgggttttccatgttaccaattcactacactgttgagatttgattatcagatgtgtcaagtttcgtttggttccctagaagggagaaaaggctgcttatgcaggcagggtattaaagatgatattaatatctgcagtaatcagtaacagaatatataaacttaataataaacttgaaggtacttaattatccagcagataatcttctgtctcaccgtacacttttgttatatcataagcataagaattgttttatcaaatattaccaaacaaaacttagttttgtttggtaatattttataaaatatgttaccgaaagttacttcctataacatattttataaagaaaaaaattaaaaactccatatacctaagaaatgtaaccccccctccataacaacaatttaacaaaaataaaaacctactttttttgaatttggtaaattagttttctatcctttttagtaacttcctttcttattttctttttatattggtaaagtttaatattacacattattttaacatgttataattttttgtgatgcttaattatttgatacatgtaataaaccatatattagagctataaatcaatgacaatgcatgtagatacaactcatttatgatatattttgtttatatatataaccaattagataatttgtctgcgctttgtgcagtcataaataataattgcattgaacttgcaaatatttttttttaatatccatacattaaaaaaaaagaaagaggaaaattggttcctaaaatattagcaatattcaaacatttatttgattattaatcattatcacataacttaagaacgtctaatgaatgaattattcacgaaataataaatcattggttctaaaaaggaatttcgtaataaaataaaaatttaagttaccatattcaaaaaaagaaattgtgcttgaacatgaaaataattataatttttgaacttgtataatgaatttcttcaattcataagtgggaaatttcatatttatgtaataatagataatatgtaagctctaatatagtactttaggttatagaatttaatataaaatatcaaaacatgaattcttgaaattgagtagagtaattattttctgcacaatgaatcggagacaataactttgaagaaatataaacaatagagttcaaaagatgtagtcaaaaacaacaattaatatcataagaataaattaatgagtgtaaaaatgcataccacgatatgtaaaaacagaatggaatataataaaaaaaatcgagttcactgaatacacaatgttcctttaagaaaattattctcctccaataccaacgagattacatcctctaaggatggaaatgatttcattccccaacttatccatataaaaatagtggtgttagtatgtaactcaataggagtaaaatacacaaatatttaattttgcgaaagtagaagaagaagatcatattttttttttaaaatgagaggatatatcactatttttaaacaacaaagggtagtgttaacaaatttttattgtgtcttgtctaaaaggttacagctatttgaaaaagttacaacacttcgaaaagtgaacaacatttcataaaagtcgtaacttttcataaagtcgtaactcttcataaatgtcgcaactcttcataaaaattacaactattgataaaagtcaccactcttgataaagatcaccactcttcattgaagttgcaacttttcataaaaatcacatcttttaataaaaaagaaagactagtttttggaataaattaatttaaaagaaaatttttgtttgtggtggggcgccaagtaggcaggcgtagggttctttttatataaatatatatgatatatgattcaatatttgatatatatatatatagagagagagatgacaatataagacaattgcaaaaaataaaataaaaaactaatcgagtaagtaggcaaaaaattatttataaaatatatgtagaatttctttatcagatatgactgcccaaatcttatattcaaactaaaatgcaagatcaatggtgctatatatagggttttacacaaaaatcaagatctagtcttgcaaatttaaataaaaaacagtggtttacgatgagataatgtagcttttgtaaacaataaaactagaaaaataaatgcaaaggcattttaaaggatataataatgaagatcaaaggcagagaagggaagaggcagcaatataatgaaggtaacatcatggttccattctaatatatatgctatttttctttagtaaatttcaaaaataatgatacattttcatatttgataaatatttaatgatactatcaacattttatctatattgagttccatttatttgaccaaaacctcacaaagatgtgctcttcgatctattcaaaatttattcaatttaaggatagctttaaaacatgacaaagttttctcatatatttcttaaattttatatccagtctaaatacgtatataaactaaaatgaagagaataatatgaagctttatttgatgacattgttgaaataaccaaaagctataagtgatacaatagtaaatttaccattggtcaattcagaattatttaaaagctaaaaaagtcatataagttggggttgctcaatgtatagtttttggcttgttttaagcattttaaaactttttttaagcgctttttaacattgctaaacactcaaaaaatgataaatagtatttaaatttgatatgattagcttaaaagtgaactcatataccttcaaagtaaaaatccccaattcgagctttcaaaccacttgattttgtggatgaaattatactgaagttgaatatatcactatttataggggttagtgaactaatacctttgattatttggtagaaatatgtatcttagatcaccctaatgagctcccacttttaaaataggaaaaacctcatatgaagttcatcactgttcattatatatcacttttattcaaaaacgtttacaaatgttcattgtgactaaatacccttgagtgtcgagttttcacaccaataaggcctaattaataggtaaacaaaactatgtcaatcttcaaaacgcaaatctaattatatttttaacaagattagaggtatatatacatattctcttatgttaactcttattcattattgaacaaactaagtaagtgtacccaaggtctcaaacaacagttggtacattctttgtatgtcttcctttgtctcttaatagtcgtctcctcctgtcgatgattcctccaaatacattaatcaaaggaaaatctttcgccctcaacttgcaaacttgtctatctaaaattgttaacaaagtttcttcattagagaaactatgatttcttgaatgtagcaatttgatgtgccatgactatcatcttgatcaacatgcttcttaaccatcaaaagatcctaaactagatgcatgtcatgttaggagacatattaagcttgtatataactacaccaacatgctttaggatctcataagatccaaaatttcttatttgggagattttcaatccaacaaccatcataatgagcaacgtgatgttataacatctctctcacactgccagaacagtcttataccttgtcggagtgaaggacatccttaactaagtagattcactaagctatacttaaaaagcaataaggaatcatctaaaatgtgtgactcttaacccatattggcatacatggtttatgggggttattaattgtctgaacactcccccatataaatcagtgatcaatattaatcccaataatatacactattatgatttgagactacaccctggaagtggccggctctcaagaaccattgctgatctccaagccaaaccctcattctggttgactacaagctgaaggcaaactcaagtatacaaagcttaaaacataataaaaataatatactcaactcgccacaaaataggcatttaagtctttaaaacatttttaaaaataaatgaaacaaacttctcaaactgtaatgtatatctatgaagcctctaaatgaaaaaaatgaaggcagatgagacatacggcatcctaacaactgatataactaagagtacaagtggagcccttcggatgtaaggaggctcatcaaagctaatgtgaactccatgtggtatcaatgaagcacctattgatgaccgtgaatacatgtatctgcatcatgaaacgatgcaggccaaagggcttagtacgtgaaatgtacgagcatgtaaagggaattcaaatacataaacataggcttgaactttgatataaaggaaacatacttacctatttttaactcaagaataaaaaacatagttcaactcaatgaaaagacactcaagtcagtgaaataggccgcaactcaataataagatattcgactatgggtaatcaactctgggtactctattcaatataaagtaagaatacaaatgcattatatggaaagactttaaaacggtagaaaacaactcaatgtattgaaaattcaatagtaaattagtttgtatgtaaggaacaatataaactttgtttgtatatgaaaatacaaaataaactttgtgtatataaaagtacaaaatatctctgtgaaagtttctctaaccaacaaccatcactatgagctttctgataataccacgtttcgcccatgatgtcagaactgtcctatgattttccagttcataagacctactcactaagtggatccacaagtctatgctaaaaaatatttaaggaatcgtctaaaaagtatgactcattctacccacgttggctacatgatttatgggggtcgtaagttatctaaactctcctccatatcgatgcgtaatgctactcacaaatatactagctcacatgtttaaaaatataactcgttttgtttgagatcattactcaaaatccttctcttaaaagagatgatactcaaactgctcaaaactcttttggaaatctcaaattcgtctcatcttaaatgtaaaaatatttactcttgggaatacatagttatcatatatcattttaaagaaaatgaactcaactctgttctttctcaactcaagtgctcagtcttaaaccaaattaaaaaaaagacttctcaaaataaagtttatgtcgaattatggacgtgaacaattcaattcaaagttttcgataaccataactaaaactaaatactcgagactcaacatcttagaactcaagaacttaaatggtaatacttctttcaagaatgctcgactcagaaggttaatgcagaataatgtgcatgaattactcaactaaaggactcactgatactactcaatctcaagattgctcgactcgtagggttaatgcagaattatgtgcatgaactactcaactcaaagaccttcataggtaacatgtagtagccccatgatttggaatataatcccaaaatgattaggaactcaatactcaggacttagaacttgaagataatactacttctctcaaagatacccaactgacggagttcatgcagaatttatgggcatgaactactcgactcaagagtctaaaacacaatatgacactcatgtatataactcttctcattctaatacttgttttctcaaaactcggtttaactaaatagttgatctcaaaggattcacaattgaactcaaagactttctttgactccactcttaattctctcttaaatttgtatttgaattatgaatttaagagttatgattcatgatatggggaatctcaataacaatatagaaatttgataattaggaatagtacttttaaaagaaaacatgaattcaacttaaaatcaacttatctaaaaaatattcaaatatagggaaagtatcctagactactgtgctactgatctgaaagtagatgtaggatgtgaggatgaactagtccaacactatgatagccttacatacctggaataacgaggttcttggaaaatcttcacttgaagaagaacttgattagaagccttgaaacctagcttgaaggtaaacaatcaagaaaacctttcttaagattcttgaattagtttatgaaaatctctatgaccaagcattttgattttcactagtgattcataattgtatggaggaatttgaattgaaaaagatgaaatgcttggagaaaagctatctttgaagaagcttgaaaaagattggaaagtcctgtactttgattttcccttaggattttgtcttagggtttgagatagaaaagaatgatggactaaaagatgaaaatctaattgtttggatcctttttcagccaagaaatccgtttagggttttcttggagacaaacaaaataaaaaagaccatttttaatatttttccgtcggctaattcgtaataacattgtatcatgttattgaaagagtcataactttttactcaaaaattggattgatgcgaaattagtggtgttggaaagtagattcaagtacctctaattggataggttattccctacataagtctttatattctaaaagatatggttgtttgcacttgacctaagtagaattttacatgaaaacttaatagagaaggaaacttcaagaactcatcaagaaatttcaattgctcaatatttatggataaatttgtagaagaaactcatgattgacatgcgggtgaataaacccaacactatggaagcttacatacctcaaagaactaggttcttggcgaaatcttgaatttcttcaacgaacgcttgaaactttgaactttttctcttcttgaactctcaactaaaaccctaggcgtatattaggattataaaagttaacatgataggattagacctttaaaaactttctaaaatgaattaaatctgatttagcatgaaaaagaccaaaataccccttactattttcggataacttttcttaattggactgcctgacttcaaaaaggtatatctcactcatccgacctcaaaatttagcaaattcagtggcgttagaaagctaatttaaacacctttcattttccatctcatggcacacataactcattctttaaagagagctatgatcgttcaaattaactcaaatcttagaagaatttaggaatgtcttgaacgagctacatctagtgaccttaacactttggaaaattttaaatttcttagtaaaaacttactcactatgaaggatggttcaagtcttagctcaaaattttcctaagttgctatatatactcatgctcatatgtttaaaaccaaaacccttcctcgatttgaattaattaccaaaaagattctcttaaaaagataatgctcaaaactccccctaaactcatttggaaatctaggtttcccttgttttaaatataaaaacatttactcttggaaatatttagttctcagatattcacttgaaaaaaattaaactcgactctcatcatcttcatactcaagtgctcaagtcctaaaacaatttataactaattgtataagacttctcaaaatagggttcattccgaattatggacgtgaacgactcaattcaaggatttcaataaccatatatataactcaataataggaactcaacaactccagaactcaatgatactactcatctcaagaatgctcgactcacagggtctttgcgaaattattgggcatgaacaactcaactcaaagaccttcatttataccatatggtagtcccataataggaatataatcccaaaaaaattaggaactcaatactcaaaaacttagaactcgaagatattactcatctcaaagatattcaatttatggaattcatgctgaattatgagcatgaacgacttgactcaaggatctcaataataatgtagactcatgaatacactcttctcattctcatactcacatactcgagtattaaaataaattataagtaattgcagaagactccttgaacagactcaaaaggactccttcgaattttactcttaatgctacctgaattttgtattataaatttaaggatcatgattatgatataaagaatttctcagcatatatgaaatgaacgaatttgagcattgaacgtctaacctcattttttaattattgtgatatgtagagtggtgcaaaatcacagatacctctcttgatgcatttctatagttacgttgatgtgagattatatatagttcagcagcagcatgttgggaaaattactaataactcttcttttatatcaaattgttgaagcatgatgacaacacttgaaaagtatcaacaatgcagttacgcatctttggacccgatgttaccggttagtgatactcaggtattgtttatctactttatcatgtcgtaagtatattatttgtaaagatatatatcaagatagttcgattgcgtacacttacattttgattatgtttggtgaatactattctaatacctttttttttcctaaagcctaacaaataaagataattaagatgggaacgtaattcaagtacaacatggttccatacgtgacatatttacacatatagtggaaccaaaagagcaatttttcctaatatcattttctaaatatcacgtgtgcccgtgattcttttttatggacatgaattttttttttaatatgagtggaagtaaggttcgatctttctatctgctttgatatcatattgaatcgtgtgattgtctctttaaaaaattaagcaagagcatattttattaattaattgtctttctcgacgtttttctctttcaacagatgaactacaatgagtatgtgaggctaaaagctagagttgagctccttcaacgttctcaaaggtaagatattagtgatgtaattaaatgattttagttagatttacataagtttttaataagtgaaaattaatagacatattcttggagaggatttgggcacactaaactcgaaagaacttgagcagcttgagcaccaattggatgcatctttgaagaaagttagatcaaaaaaggtatatccaaatactataacttaaatatattgtaacgatttaattaatagcatgtgtcacgttcatctattctttagtcacaatatataggggcatgtccttaacaacgtgccatgcctcgatagtcatttttgtctttttgtgcgtatgaatttaactttgacacaaatttttgtagtaataataactcatgctttagcatcttaggaagcagtcatatgaaaaacagaagcatatatatatattacatgagttaatttaatttaatataaaatttaataaaattgtgtctcgctataaataattttattaaaaaattatataaatatattatttttttaactggccgcaaagttatataaattgatagagaaagaggttttggtgtaaggttcattttccaacaattagttttataatttgtaagtgcacactttatcagactcaatctatgctggatcagctggcagaccttcaagaaaaggtacactgccttaacattacaaaattaatttatttcatcaaaagcatatcataaaattctgacaaataaatatattaggagcaaatgctggaagaagcaaataaacaactaaaaaacaaggtacatatctatatatgtgtgttaattaattaagttgattttgtatttttgtttaatgaataattgtttgtgatcatcagctggaagaaagtgcagctagaattccacttggattgtcatggggaaataatggaggacaaacaatggaatacaatcgactccctccacaaactactgcacaacctttctttcaacctctccgtttgaattcttcatcgcctcaattcgggtaagtatcttattttatatgacttagtttgacttgacataaagtttaataaagaaagaaagacttttaaaacttatagtgtaaaataagtgaatagatatatatgtggttgtactaacactacaacaaaaataattttcagcggcattaaatattgacattaataatgagtgctaaagactttatcggtattagttaagtgtcattaggatcaatgtcgttaaaggcttcacggacatatacaaagagtgacaattgccgctaatgattatttttgttgtagtgaaaatgagtattttaaagttaaattgttacataatatagaaatatgtcagaaacaggacaaatataccaccgaactatcatatatgttatggagatattctcagtcatacttctgcgacattggtactcatgtcgtccaaaaactagaacatatatataccctttatatattaacgaagatacaagtgtcataatcttatgcaccgattcgatatttattaaatatcgaatcgacggataaaattatgtcacgtgtccctattaagtcttctattagagtaaaaagcatatattctctagtttttgaacgaaaaaaggtattaatgtctcaaaagtataacgaaaagcatttgcatacaatttatgataatttggggcatattaatttatcattccccctttttttggcactgattaaaaagaaaaagaaagttataaaaattgggatagagggaataattgtttcatagggaaaacttagaagcttctcagtatgtcagtgagaatgtgtttcctaattagtgaactatggtttggtgaaaaataaagagaaaaaaatcagtacaaattttccactgattagcaatgagaaaaatatttgtttctagtagtatgaggagaggatagtccgcataaataatccttaaatttgtggataaataaactattttcaatagattatcgtctcaaaataaaataaaatgattgcaagaaaagaataataggtatgctggtaatatgtataatacactcaaatttatttgctgtccatgcagatacaatccaaatatgggtgcaaatgatcatgaggttaatgcagcaacaactgctcataatattaatggatttattccagggtggatgctctaatggattaacatagtaatatttgttctcttgtattgtatgaactaatataattaatgttgtttttgtggtggccactaatctgtatttagcaacttacaattattgttgaagtagtgaggagaataattcactcaacttgttataaaaataacaactgccggccccatctcaactatgcactatgacatcttggaatttatgatatatatatgtatctaatatttttgtttagattagtgatgcttgttaacaattcagtgtatagaattctagcatatcctttgaggattaatcctcttgaatataacataatgaatggttacttttgatgtttaacaaataactacagaacaatcaggtctttaaagatatcggttatgtcattaacataataccaagtgttatgcaaatactgaaagaatgtatattataacaagaagttacaactcaaactataaggtacatcagtagcagcagatgttacaatgaaacgtacatgaccttttgttggtagattcgctcttttgttgaattctaagaaacgtgactgacccaattttacatcctcttttggaatcgtataattgtcaaaagtgagttactgtttatcagagttattatagtccgaatactcataaggtagggtcgacgcctcctctcaccaaactgtacttgcaagttttccgcaaaaagctttacacgcctactcttagaaagaacactattttcctatagttaggtagttctccaataatttatcaggcattgtacgaaatatttgaaatacaggaaagaaatatcattcgggtaagatttccaaagggattgcaaatggatccgccggttcaccaatcattgatgattctaaaacggctctttataacaaggacaacgaaacttgatcaaatacaataggggaatcgatgccacatctatgatctcaaaaagaaaaataaaggctcgtcggggtaagcagtctgagtatagtaataatgcacttatctttgttctctattacctattaaatcaaagcaaagcttttgatctctccctcaaactaccgccaatttgaatttgtacatataggacaaatgctcccattaccatttctttctgtatttaaatattattagtatttgaacacgcatgttgcgcgtataccccttttcagtgagcataagtatttttaaaaattgcatcagtatataataaatatattcaaaaatcaatgacatccaatatctaaaatgt

SEQ ID NO: 318 - DNA, 5534 bp, Solanum lycopersicum
tgtccttaaaagaatgctagtctctttaatatgacttaaacaattttcgcctcttaaactagcattagatctatatatgacgagacttatttattgatataaataattcacataataataagaaaataaattataacaattcctcttagcatgttttaattaagttttaaaataggataaccatacattttaactcacccttggttaaaaatataaagggaagtattaaaaacatctttcaacttgacatagattattatgaattttgtcacgaactatagatagcctttaaaaatcttcattttgactaactaaacttgaatatatctatgatcttttgccacatggttgaagtacattcctaattctcgtcaagttaatgagtgtttcaacactttcttggactttctattaagagatacacttttaccaaagtattaagactatttactatgccatgtgacaaatcaaatgtatattcaaattgaattagttaattagagagtatttgaaacaaacttgattccaatagaagtattgttatatatattaattactgaatacaagttacgatgtagattatacacaacaaagtgatgacaccactaattaataagagattaacaaagaaagaagtaactagaaagtgatgagatacaagtctgtagaagggagatgagaaatataagaaaatcaaagcttcgacataattttcataaccattctcctaactcctaatcctttttaatgaagtgtaaatgggcctttttcacaatattttcgtaattgtcaataatttagaaagaaaattaataactcacgataagagtgttatcagtacttctctcgaatataaatgctgttgggtgacaagtgactgataactgagacgttgtgatggtagggacaactacaacaagtgacaattgattgattcttaaattacttttatcaaattctgcaatcacctttcattgttttggcatccctttccatttttagtaactccatctttctaagactcttctcctcctccaatatcttatcacaaatcaaaataacaaaaaacatagaaaaataaatcaaaattgcacaataaaaagttaacttgaccttctagggtttgagtattcaagatctcaaaaaaaaaaaaagaagaagaagttatggctcgtggtaagatccagatcaagaaaatagaaaaccaaacaaatagacaagtgacttattcaaagagaagaaatgggctattcaagaaggctaatgaacttactgttctttgtgatgctaaagtttcaattgttatgatttctagtactggaaaacttcatgagtttataagtccctctatcacgtaagtaaacaaactttattttatttttattattttcaaaatttttgtgtttgttttaattattttgatgttgtttatgttttgtttaggaccaaacaattgttcgatctgtaccagaagactattggagttgatatttggactactcactatgaggttttcatgtctttaatttcttccttctaagatctttaactttcccccttttttttggttaaattgtgtaacaaattcatcttaaaaagtgctttttatatttgtttttggaatcgatcacactttctatttatttggttatattttcaacatgccctttacggttagatttaattcttttttatgtaaagattcttgaaataacggctaagatatgaattatccaagatctcgatcgatccccatgttttgatatcaggaacttcatttaatcaagattttatatagatctatgaaaaacaatttttaagatgtacatattacattattttctatataattttgagtgttcaattgatcatctaaatcacttttttgatatcacgttgaattgtatgtgcgtctcatttaaaagttcaaattattagaaaaattgttttattttcttgattacatatatttttgaggtatttttacgatttattatttgttaaaaatgagcagaaaatgcaagagcagctaaggaagctaaaggatgtgaataggaatctacgaaaagagatcaggtagatatctacatctttaacaagaatctatgactttttaatttattgataaaaaatctaaataaaataaaataaaattataattttattttattttgttatttattgatattataatttatggacagacagaggatgggagaaagcctaaatgatctgaactatgaacagttggaagaactcatggaaaatgtggacaattctctgaagcttattcgtgaaagaaaggttaattccaattattagactaaaatttctaaaattgaaataatcgtaatcgaatcactttatagttgtcgagtgaaatctaagaaggtaattaatatgttgcagtcttattcttacctttacgggtaaagatgtttttccttcaattgaccctcgataatccttttcatttagatgaacatgagaatgatgatgtgaacaagctcacaaagacgaattttaattgaatcttgatcaaaataactaaaaaagatagagatacaatatgatctagaatgatgatgtgaacaagctctcaaaatactttgttaggacgtttttggagagtcaaactattcaatattttaagatatactaaattcaatggaaattcagaagtgaaatttaataattattttagaataaaatagtatatatatatatataaaatgacaatgttttctttctaccttggacttttacttcatagtcctaagaaactcagcttcttctcattactaaacacttattgttcaagaacgtgagctaatacatctaaaggccgatcgaatggatgcagatctagagattggattctttgtgattcatattacttattactatccgtttatcatgtagattcatgagtattttatatgatgcatattgcttattaatataattacctctttttacttaaaaactaaatgtatagaaaagagtaatcaaatgtgttcattttttattttcttgccttccataaagttggtcattttctttcaagtaagtaatgcctaactttattttatttgtgaaagaacagtttaaggtgattggcaatcagattgaaacttacaggaaaaaggtaagatgtcatatttctatatgttgaaatataagtaactaataaaaagtgtgttatctctttaagttaagtttttagatggaatgatcacacacttaaatactaaaaaaaagaagaagaattcatattttggttgattgcaggttaggaatgtggaagaaataaatagaaatctcctacttgaatttgtaagtgcttaagcttgttaatacctttttttttttgcatagcatagaaattaagtttgttttttcagtcatccacaaccctattttgcaatattgcttgataggagtagtagttagaagcaaaagcatttgtctaggatttctattgttctctaaatctagaaagaactgttattttgctcggactattcaaaatgctactgcatctgtttttgattttcaaataatgcactatttgaggagaatctaggacatacctgtcaacttttttaaaagttcgagcaagatagaattaaatagatgttacagttgggaatagtattcttcccaatgtttagtgatctatccacacaattactaaaaggcacacatgagattctaccataaggcatttgatttacttggtgcaaaatcaagtatttatacttgtatagtgaattttatgataacattactattactacgacaagatagagttttacggatggtaaacatcttcaatctccgaccttaaaattttgatacctctaagttttaaaaaatattcaatacatggtgatcaactattctcaactcatttgtgcaagatacatattgtgtggcaaatgaaggattttcacaaaggagaattttaacctctgttatacatagctaaaagacttttaaccttatatatattaatcgacaaaaatattcattaaaatcccgtttccttccctctttctctgccccaacaatacatgatattgatgattgattttgactggcgtaggatgcaagacaagaggatccatatggtggattagttgagcatgatggagactacaattccgtgcttggatttccaactggagggcctcgtatattagacttacgccttcaacccaacaacaattatcataatcatcttcacagtggaggtggctctgatattactacttttgctctaggttgagtagtaattttcaccttattgtaatattgtcatactttctaaataatcacatgcaatgtttgttcactagacatgcatgagagtactgactctttagactattctcctacttttgcttaatccagtgtgttaaaacctaaaaaaagaaaaactataaggatgtcaaaaactctattgtttttggattgaagtgttgtgtatcttctaatgtttaatgtaatgttttagtactatcttatatatataaagatcatgtggaagtatggaaatgttttaacttttagtttcgtataatgaattttatatcagcaatatttattagttcaaattaatgctttttccccttcatgttggtatgtttgtcatgatacaatgtctacattatgtcttgtatgtatatggtttaaagttttgtataaaatgaaattagtccttagttattattattattacacaatgtatgatgtatcataagattatagttttcactaaaattattgacttaattcgatcgaattcgtacctaacctttgcttagatcgaattatatataatatatttatatattcttgtagaaaatgtaagaaaattttgcccctttttaaaattttgtcttagataacaataaatgaatatgaacttaattaccatgcaacataaacaataaaaatttatatagccaaacatagaagtaataaatgtttttatttgggctgctgttgttcaaggctccctttcaaagtttcaccacttgcattttatatatttttgaaatgaacacgtagtgaaaatctaaatagatagatattctttttttttgttattggaagcttaattaaaactcaaaatatattgtttatttgttgtagtttatgttcatataggtactaccaaatttcagtcacaatattgtttagttttatcaacaatattagagcaaggaagcttcatttttttttgctcatggtaagtggatattctttagtatagataaaaatttaaataagttgctaacaattcttttatatattttttaagtgtatcgtatcataaattcaagtgcttaattagaataaattataatgagagtatctttatccacgagtttaaatgattccatctttgatacgaatgctaatttaaccttctttttttttttggatcaaatgactttcactcgttctaatctaaacgatgagcgcctatgtggagcttatcacaatcaaattagtcaaaataaaaa

SEQ ID NO: 319 - DNA, 3680 bp, Solanum lycopersicum
accgaaaagcatggacaaattataatgattaaagtaagaagaagaaagaagaaaaaaaaaggcaaaaaaatagagagaaaaaagagaagaaaaattactcattacattttattttagttgattagactagccaactacacacacgcatacattcacccacacgctcaccaattcaattcatttcattcattcataatagtaattttacaccttttttaaatttttttttttttgcctcttatctatagctagctagctctctattgatccacctttttttttcctcttactttttaaaatggaaatcataagtcaacctcacctcatcatttggtcttggttcttataggcacccacctcatttcccactttcttttattattaattttacctttttttcttcgatactttttttttccagagagtaacgtcaacatcctgtctataacaaggtgtacgaagaaattggagtgatttgagtcgatgttagaatcgattaatcattttcttcattaccttgcttttgctaacgttgaataacgtcaatattttatttatgacaaaggtccataagggtggtggagtgactcgagtcatagccaggatcaatataacgctcgtttggtggtttagttgagaaataaaattatgtccttgtgaattacttaactttcaaattcttgatttatatatgttcacataaatatctaattgaatttgtgttagacgatcacaattttcaaaaattatttttttaaaactttatgcctcgtcaaactatgtcacagtttacctaacacataattcaggttaaaattttaacttaatatagattgttagattaattaccgcatatagttatcttttaggtgacttgatgattgcagtgtaaaaattcttttttacactagcaacgaatgatggtagttaaactccacctttttttagtaggagtgataattgagttctatataatggggatgcctctagtggcatatgaatactaaaagctgtctagctccatgtacatgggatcatcatcaggaagcttaagtatgaaggtgcatcaattcacacgtggattcttagagcatgaagctgcttctccttcacttacacttggttgcaaacgtttaagaccacttgctcctaagctcaacacaaccaataatgataccacaactaccattgttactcctccttttgatcttaagagtttcattaggcctgaaagtagcaatagccctcctaaacttgcttacaatgaagacaagaaagactcctctcaggtaatttctaaatgtttttttttttttgcatatttacgtaatgagttcagttgaactaacagaattcgtctttagtagatgtatgagttcaactgaattcaattgttttgacttaaactttcttagatatgtacgaatagtacatttcaaatcgaataactcaaatgaccagtgcattcagcttcatcatgaattcataaagtttaaattctgacgtcttatcacatcaaatgataaagggaatattcttactaacatcttgaattcataaagtatacacttgattccactagtggcatgttaggacatgtaggagattcgcgaggtccatatgaatatactttttttttgttagtgtggttgttgatgttttacttttaacatatgtaggtggaatcacacccaggaggaacaagatggaatccaacacaagaacagatagggatacttgaaatgttgtatagaggtgggatgcgtacacccaacgcgcaacaaatagagcaaatcacagcacaactaggaaaatatgggaaaatagaaggcaaaaatgtgttctactggtttcaaaaccataaagcccgtgaaagacaaaagcaaaagaggaatagtcttggccttagccaaagtccaagaacaccatcagccatagtcactagtcctttgtcatttgacactagggtatgtctcatgacacgtttataactaagttatatacactgtcagtataattttatttaaaaactgtccatctattttgacatgttataacatgttgcgttatattgttacttgttgtaacgtatcaataagtatattaattttgatatgaaccctttgcactactgtattgatctgtagttatcttttaattgatctgatattgatttgttactcgatacagggagaagtagtgagggatgaagatagtccatacaagagaaagtgtaggggatggacatttgaatacatggaggaagaacaacaacaacaagatgaagaagaaattataaattgtagagaaaatggtgataggactcttcaactcttcccattgcatccagaaggcatgagatgatgaatttattataagaatattcttttttcctttttaattatgatctgactagcttccttttttttttttacttattttcgtcatctttaatttttactttcttcatttgcatgctttgtttccttttcttttatttttttccttgttttgggaaagagaaaagagaaaagagagacatatgaatcatcaaatctatgtagtaccaattcacttctcttgaattttgggcattttagtgacttattcctgacctaaaataccctatctcctatgtctcattggaaatgctgcaaaaataatctattattttcttcttcttgtggttgatacttatatgtcaattcttatttaaaaataaaaaacgaccatgagaaatcgttgcttagtaatattcagtaaccacctctatttttagttttaaatttgtaggttcaaatcactaaagaagcaataaggtgacaatgaagtggtagaagaaatatgccaacggatttttaggctaaattagttatctcacctatcaaagtattggtctttgggttgtgtctctctctttaattagtctataaaatacttaaagatgaaatcaagatttaaaatttataaatatttataattataataactcaagtaaaatactatgataacagttagattaaattttaatatttaaatttttttttaaatattattaaatttacgtaaatttaaaatgaagcgtctagattttcgatgatattattcacaaaaggggtgatgaagacactgaagtccacgcacatatctttatataattcttcttttttgttgttatttgagaaattcaaagctgatggggtcggattagtggttgatttttctttacattaattaatatgttattcatgctaagctatagtactttgatatttgatttttaaaaaaaaaaattcaatttgtggaagactttgataaagttgcttagcccatggcatgtcaatcagaagacatgcaatttcttttttattttataatgttgactaatggattgtggggtagaagatcagttcatagatatgactttggagggaaagcaaataaaacttagatttaaaataaaataaaataataaagagtagggtgtagttggataattaaccaaataaattaatatagttaatgatggaatttcgattaggtagataattaatgcaaaaggagattgattcattatatctttaatgtgtctttttacttatttaggtttatgtttagtcttaattatttagattttaattattttattttatttttcaagtttgaatttatctattaat

SEQ ID NO: 320 - DNA, 12802 bp, Solanum lycopersicum
tagaaaagagtggagattgcatattagggtagaaggtcaacagaggtagagtgttatcttgccttgcgaagattgttgcacacgactagtcatgctctaatagttattacttattcgtagataatcctgctaatcataaattgaactattactagtattaatattgttatagcctgtctataaggcgagtgttgtttatcacactattttgttgttctttttgtcattaattatttgtttacttttgaattgacatatctattaacaaaacaatgattgatatagtcaatttaccattttacgtctatcagttatgaaatagacgaattaaaagtttaaaattttaaaaaatattttacttttttcaaattaactaattgaggatataaaaaaaaatttcctttcttaatttgtcaatatgaaaaaaataaaataaacaagtaacaaaagaccaagagagtattgttttttttagattctcaatatttgagcactttttacgcatcggataaacttctaaagtataaattatttagcgatttttattatttctttcttatagattttacactattttctttttgttatctatttgaatcgaagatttttgaaaataaactttttacctccagaggactataataataatatttgcatatattctaccatttccggagttgtaagttatttcatggtatagatatattagtagaggctattattggtttttaattttattaattaaaataaatatttaattaagtattagttagatttgcttcttctccccctttccatttgaatattattatatttgaagcaccgtactctgacaatgactagtgaaggatgggtagcacatgcctcctgtcaaatcacaactctattgaacggccacgatcaaccgtacgattctgtgaacggctgtgatctcctttctcccaagccttcctcagactcactctgataacagcaagaaagagagaaaatgagggcattactattacctctcttttctctctctctctcaactgttatcaggtcgaccttggtcgggtggggtataaagagactaacagcacaccctttctctctctccctctcttcaaaactgatagtgatatcagaaaaagctgaagttgagctcagcttagattctatcaacttattgaattgaagaaattacaatttaatggaagtattggagaaagagtagctagctgaaaggactttttggttaatgcatgtggggagatcatattcataatggagaaaaggtggggtatcttgaagatagggtttcagttgatttttggagttggaattgagggttttctgcaattcagtggattattacagagaagggtgtagagtgagtgtagtactataatttttctcaagaggaagtgggtttttaaataaataaataaaatataattatgaagctttcaacatcaggaatgggtcagcaggctcatgaaggaggtatcttctagcttctttatactttttcttctctttggggttttagctttttgtatatcactgtcggtatgtttgtgttacgctttgtttttgttctaataagataaaaaggaatatatgttgatgtctatatttgttggttagttaatgagataatcttaaaagtatatgtaattaaggccaattaatttattgctgatggattttttattctgaaaggagagaaaaagtgtttgaactcagagctatggcatgcttgtgctggtcctctggtgtgcctaccaactgtcggaagtcgagttgtttactttcctcagggtcatagtgaacaggtctttctccttttcattctttatcacacaaactgatacaatctattattttagttataaatcactgatgttcccttactggaatggagtgacaggtagctgcaacaactaataaagaagttgatgcacatatacccaattacccaaatttgtcgccgcagttgatctgtcaactccacaatgtcacaatgcatgtgggtttcatctgttacaatctatgttttgctatgcaagttgtattaggcgcataggttattgataacttgtcgaatttcaggcagatgttgaaacagacgaagtgtacgcacaaatgactttgcagcccttgacaccggtacaccccgagtgttgctataaatgattcttaataacattgccttctttgcatcagctacttgtgaatggggtctcaaaaatactctgtgttggatttcaggaagaacaaaaagatacatatcttcctgttgagtttggaatccctagcaagcagcctactaactatttttgtaagacgctgactgcaagtgatactagcacgcatggtggcttttctgtccctcgtcgtgccgcagagaaagtttttcctcctctggtgattactgatcccttggttgtcatttcgacttgtctctagtgctaagcctgatattgttgtcttttctactggctctcaggatttctcgcagacaccacctgcccaagaactaattgcaagggatctgcatgatgttgaatggaagttcaggcatattttccgaggcaagctctagatgctcttttcttattgctctctgtagctttacactgtttagagtatctttagctgtaatcttaaagccggtgggtgttttaaatcatggagcaaaagttagacactgtcatgaattgggcttgtgcttcatctctgattttgttgcaatttccaattaaatcatccaatttgttattttgtgtggggttgtactgttgtttcccagttcatacatccctatcctgttatattattaaaaaaatgttatctgtcagtgtcatatgtccatgtgtgaatcttattattcattaagtggggaacaatgccgaggaaaaggactcacagaatgtttgaaaaataaatgaagagaatttatagcttccttctttttgctctttaatccccaacattcatttcaatcttgatgcgtctaattgtctatctataatccggttagtacttgccaatttttctttatcaggatttttaataattgaagtacacctagagtttggatgatcatttaggggtgggaataggaaacaatatagttgttttgttagtgatgtgaaagagattaaggaatcggatatcacttcctctatcatgttgtatgatgttctctctattttaggatgtgccgaaatgttaacatcattcgttgatgacattattttatatttctttcacaactcctgaaaatttaaatttcttgtaacttcaaactttgattcggtgattcttcaatcagatatattttgtccactattactcacaaaaaagtaaattaggtgacaaataaagtagtatggtattgcactaaaaaaataaaaaaggtgaatggtggtggatagatagggtgagagtggtgatggatggattaattgacagaaataaagtagtatgaaattgcactaaaaaataaaaaaaggtgaatggtggtggatggatagtgtaggaatggtgatggatggatagctttggggtggtggtggatggattatgatatcagggtaagtatattacttcgtccctctatccctaaataattttttacagatttcagtgttgcaaaaaggttaaggaggggacaacatcaaataatagtatgaaattgcactaaaacatatatgtggtggatacacggcctagggtgatggtggatggagtatggaagcaggataagtactctagcctagtccctctcttccttaatcttttgtttacacatttcagtgttgcaagaaggttaaggagttcaactctcaggttatattggtggcaaaagaatactacaattctaaatatactttatctagaaagagaactacagtgaaaaatctaagtttccgtgcccccaaggcttagctcgagtggcaaaaggtggaggatttgtggtttaggtcgtaggttcaagccccacaccatgcaaagcaaagcccggtatttaagtggaaaaggtagaggggcgggcccattatccacagagtttagaaggttgtgattggtctaaagggtgtgtgattggtccaagggtgacggacgaatttctcggttatcaaaaaaaaagtcttatgttcatttctgcttcacaacaacataccagtgttcatttctgcttaagatttaattatttaataattcataagttgtgcaagagtagggcgaatagaccagatgagataccagtgaaatttgaaagaacataggctaggtggttttggagaggttgattgagttgcttaatgtcatttctaagacaacaaaaatgcttgaagaatggaggtggagcatgatgattccattgtataagaacaaaggtgatcttgaaaattgcaacaattataaggggatcaagttgttgagccacactatggaaattcgggagagagtggtggagttgaaatgaggaagggtgtgactattttgagaatcaatttggattcatgtcgcgaggagaatgttggaacagtattgggagacgaagtaggagggatttacacatggtgctcattgacctagaaaagacatacagcaaagtgcctggggaggtctttggagatgcttagaggctagagattttcttgtggcttacactagggttattaaggacatgtaagatgaaactaagactcatgtaatgacaatgggaggagactcagagcacttccaatcatgatgggttgcaccagggatcggctcttagtccatttatttttgccttgatgatgaattgacgcggcatatccaaggtgaagtgtcatggtgtatgttatttgcagacaatgtagtattgaccgacaagattcacaacggagttaacactaacatggaggtttggagacgaccctagggtctaaagagttcaagttgagcaggaccaaaactgtatgcttgaagtgtaagtttgatcaaaactgaatacttgaagtgtaagtttgatcaaaactgtatacttgaagtcaagtttgagcaggaccaaaactccatttttcatgtaccatttaaatattttaattttacccaatataagtgtatagagtgtggtagacaaatattaaaaaggtaaaaaaaacatccaattctctagctcatctaggtttacttggtgttcacattaattgtatcaatttatcatctttgagcattataagaatatatattaattagctatattcaattgattacacaatttattgctcagatcaattagtgacacaggttaatataaacatcgaatttatgttactatgaatgtatccatcctttcagtttatgtggcatcaacaatatatttgatagcatttcggtaattataattctaaattttgacatcatatcattctcctcaatctagctttttacttgttatttaaacattttattttgtcctgtataacgtggattgtagaatatagttgacatttttaattttacatagacgaaatgaattatattaataaataaaaataatattatcttaaccaccgagggagtcaaataaaaaagagggggtatatgaagaaaacgagtggatgactaaaatagatagaaggaaaaaatgtggttgaagagatgatagaggaaataaatagaggagaaagttgttaaacgaatgaaatgccgaatattaacggtgaaaaggatctctcacgcgctttaaaaggtgagtaatctcaccaatctgtccagtaagcattttgtgttaaaaaatggtcatgaaaagtggagttagagggttgaaatgaaactagattgagttggagtgacaaaatgaaatatcgagacaagttaaggggttgtgtatgtatttggctttctttctttctaaaattcgttttgataatatgttggatagaaggatgattactggttggatgtggaatgaacagtgtaatgaggtgtgtaactgataaacgtgtaccaagtatgctatcatctgttcatattttctccttttgcctgcaggacagcctaagcggcatcttcttaccactggctggagtgtgtttgttagcgccaaaaggcttgttgctggagattctgttcttttcatttggtactgtttaacctcctctgttgacacacctgtacatttttctcatatattgcatccagcatgacgttttcctccaggctttttcttgagatagtcggttctgtgcaggaatgagaaaaatcagctccttctaggaattcgacgtgcagttcgaccacagactgtgatgccatcatcagttctatctagtgatagcatgcacattggattacttgctgctgctgctcatgctgctgctactaatagctgtttcaatgtcttttttaacccaaggtagtatgtaacagtactactcccttgtgttttcattcatattttttaccttttttgctttcatttactgacgtgcttattgcgttagggctagcccatccgaatttgttatacctctttcaaaatacatcaaagctgtatatcacactcgtgtttctgttggaatgcgctttcggatgctatttgaaactgaagaatcaagtgttcgaaggtacggaatgaagttgtttgatcttaagttgatacatttccttttattttttgatgttaggtttgcttttattttttgatgttagatttccttgtatatattctgtctgaagtgctgtataagtaggctttttgtttcttattgatgtattggtcacctgctttaaacttaactgcagattagttgcttttaaatatgcatcttctcctatgttttgtttcatcatgaattatatttggagaattaagtctaattatgtagaaatgatgaattgggatgacggtgcaggattgttaccccgatggctttccattggccatagagttgtatatcattcttgtctggtattggcgaaaacgtagttacattctttctttcgggattaatgaagttggtggttacttttggtaaataaaccaatttcataaccaattaaactaaaattttcattgctaataagttggtgccctaccttttatgggtgtcgttgaaatccttagcctctatatttattagataactctttattttgttgataaaaccgataagattttatggatatgtgggcataaacaaaagcccctgtagtacaagaggtataccaaaaagtagaaaacttacaagagtaaatggtttccaaaaaaattacccaatcttctaagggatctcatgggtgcagcaaaaggaaaataagggataagaggctactcttagcggtaaataattcatctccatcttttcaaaagctctgacgtttctctctccatagtatccacataagtgctaatggagaaatattccaagccttgtgcctatctccgtctgccgcaattccaactaaacatcatctcttttactgtacttggcatcacccattgcactccgaacaagtaaggatatcccaccataacctcaaaacaaatcagcaatgaaaaagaagatggtcaacatcttcattcaaatccttaaacatacagctaagtaagtggtctgtcattacaatacataactctttttttcttataggtggttctatcatttttcagatacatgggcacaattactgggattggtgacttagatccagttcgctgggcaaactctcactggcggtctgtcaaggtaaatggtctattttaattttaccttgtgcttttttccttttgcatcgtttggggtttgggggtggagtggtgttcaagttgaacccacacatcgtgcggcttggatcctgctcatgccattgagtggttggcttgatggtcttacttctatcttcatctttttgatagaaaatcttttctatttcttttcgacctttttaatttctacaactttcatgttatcatgttgagtatttttggacaaaatcccagtcttcaccaatatatagcataagttttgtccacttatttctcctgcttatgcttgtatttgtgaggactgagatcttcattttcttgtactcagaaccaaattcattttttgttgcattgcttacaatatttctgcaagactactttgaactgcctttctttctctctcatgtgtttgcttgcaaacagataccacctctgaatcatcaaactaatgcccttaatattatttcttcaaatgttactcgtggttaacatctaattttctactgccaaatcaattctcacagccttatgtatatgcctttgcttatatccaggttaaatatctttaattaattttctgctgctcatgcttatctctcattaactaaaggatcaaatgcttacaatttatcagctattcacataacttgaaattttaatagtttggtgtctatattacagtactagtcctcaaaaaagaaaattgtttggtgtctaaatatcatctgatggtcgacttccatactgcaacatcaaactttctgtatcgtgtcaagttcttcctccccccatgtctatctgacatatatgtgaatgttaatttgcactacaaggtttcgtgcattactgcattgaatatacttaactcacacttcatgtgtatgttgctaagacccttcaaaatccttgatgcacttgtggagatcccacacaattgagtgtggttggaatccacagtggatttagatgtttgaccaatgattgattgggtatttggcttgattttgggttcatgtcatatttatatatatatgttatacggagtatgagaaagctttactttaattaacccaaaaaaaaactcatacatgctggtaaatgcatatcgtccatgtgccagcagtcacaaccatgtcaggtatccacaacataacttcacataggttatgtagaaatcagatattacaagtgctttgttccttctaattttagtcttaaaattagttgtatgaaaattataatctacagcaaggaaattacagatctacaatcatatactgtttgtatggtgaaaaatgtttgcttttgttgctaacacttcatatttacacaataaatttcttgaaattttaggttggttgggatgagtcaactgcaggagagaggcaaccaagggtctcattatgggagattgagcctttgactacttttccgatgtatccatctctttttcctctaaggctaaagaggcctttctatcaaggaacctcatcttatcagggtatggaacgctgaatggtcatgtaataagagaattgaagctgtaaaacatatattttctctatcgtggtaaaattatgaagtttgtagtacaacttatcaggaaagaaagaaaaagaaagagtaatggcctatgtagttttagggtccgtttgtttgtggagggaataattggttacccctattaaatttgggactaagcctgtgtttgtgtttggttgaggggattacctaaaacctggatatatttatcgtcacaatcatggggttatttatcccagataggacaatatttatagttataatcccaggataacctggttttgaaccaaacaatcctgtgtctgttaaaccccaggagtttctcatcctctcttccccacccagatagccatgatagaaggaattcatgagtttaagcagtatcattgttcagatagcaaccaattctcgttccagaagctatactagtcatttttctccttgcttttgcagatagtaacaatgaagctattaatcgaatgtcatggttaagagggaatgctggtgagctaggacatcattcaatgaatcttcagtcttttggcatgcttccttggatgcaacagagagtcgattcaacaattctcccaaatgatattaatcagcactatcaagctatgctggctactggcttgcaaagttttgggagtggagatttactgaaacagcaattaatgcagtttcagcagcctgtccaatatctgcaacatgcaagtactgagaattcaattttgcatcagcagcagcagcagcagcagcaaataatgcagcaagcagttcatcagcatatgctgcctgctcaaacccaaatgctgtcagagaaccttcaaaggcaatcccagcatcaatccaataatcagtcagaagaacaggctcaccaacacacttaccaagaagcattccaactcccgcacgaccagctccagcagaggcaaccatcaaatgttacctctccatttttgaaagcagattttgcagatttgacctctaagttttcagcatctgttgccccttcaggcgtgcaaaatatgcttggttcgttgtgttctgaaggaagtaataattcattgaatatcaacagaactggtcagtccgtgatcatagagcagtcgcctcaacagtcctggatgtcaaaatttacagagtcacaactaaatacgtgctccaactcatcatcacttccaacttacgggaaagatacatccaatcctaggggaaattgtagcttggattcccagaatcaagcgctttttggtgctaatattgattcttcagggcatctccttccgaccacagtgtctaatgttactactacatgtgctgatatgtccttaatgccacttggggcttctggatatcagaattctttatatggttatgtgcaagactcttctgagttgttgcacaatgcaggacaaattgatccaccaaatgcaacccatacatttgtcaaggtgctacttctactgtttatttcattggcatttagtgcatctgacaatcatgtgagtatagtttttcgtctatgcaggtttacaaatcgggatgtgttgggaggtcactggatatcactcagttccacagctatcatgagctgcgacgggaattggggcagatgttcggtattgagggattccttgaagaccctcaaagatcaggctggcagcttgtatttgttgacagggagaatgatatccttctccttggagacgatccatgggagtaagtgtccaattgtgggaagacttaatatgtaactttttaaatttccactatgacagaaggaagaccacatgcgtttaaaacttattctttgtttcacaactttttgatttatagggttgctttttcttgtttacattaccttcagccctgtggtattattcgatcttttcagaagtgtttttctttagtcctattataacattataatcttctctttatttacctggcatggtattttcagggcgtttgtcaataacgtctggtatataaaaatcctttcacccgaagatgtgcagaagctgggaaaggaagaggctgaatccctgaaccgtggagcggttgaaaggatgagcagcactaatgctgatgatcgggatcttatttctggaatgccatctcttggatcgctggagtactgattgttggaatgcttcaaaagaagaggactgattctgattctcaatcttctcaagggtcagaaattcaaatttcatgcttcataacctggcttctttagctttcgtctaattggtccatctcccaattgtatgttgtattttgcgtttggatgtagctgtaataggacttaagggttctcccatttgtatggtgtagttttcattgtaatcctgttgtacaagttagtataatttactgtacggctcaagatgagacgtaatttaaactaagaatctggaaagtgtcaaaacttgttattgcacttcgacctttcagacaaggaagcagttgaggatctataactggtctttcttgtaggtaaatgtttctgatgttcttttttctgctttaatcttcttatcagtctttgattgatgccaagtcaccaagaaattatttattggtatgtcaggttaagttgcaacgatagatgaaggtttcttgacagtgtgaatataactatttgcctcaacacttgtaatgaatttgttaaagaaacatgaggattagtgaacggaactgctttgaaccatatccattagctaccggaggagggtgcgactggccttgatgtagattggatcgagaaaatcgagtatgaaggaccatctcatagtgcacacgataaggagtctccatactcgaattgtagacaaagatgtcaagttaccaatagaagatgcttgtttccattcaacgtcagtccttgcaggcgtcaacgcttacctaaagacaaggaacattaccttttacccagtgatagaagggtcaaattaacaagaatttctagtcctgtaggaagagagccaacaatcaaaatgtcgaaaggttacccattgtttttggcaattcgcataccaaaatgttgtcctcaaagctaagaacttgcaaacttgtgcagttagttaactaggaaatcaagaaacctcaagtcctcacttgtgtttcttccaagactattgatctcaaagttgatcctgtacaactttttccattgtcctaggtacatttccgttgagcttatttcgagacaattcaaagtacaccaaattttgatgcatttgataatgaaacatgaattgttcctatgaaatcattcacagcaccagcaaacacctcaagatttggaagagcaaggcctatatctgatggaagcactccatacaacaagttgtgagtaacaacgaaatagttaacagaggatatattgaaaagagattgaggagttgtaccatacaactgatttccataaacttggaagatatgcaagcttgacaaacgtccaatatctcgagcgtattatgtaatattaaatacttgaat

SEQ ID NO: 321 - DNA, 4239 bp, Solanum lycopersicum
ttttattcgtataacttaattacataaaaataatttatcgttgattaaagtttgccaacaataaaatattgaatagtattatctagtagacaaaataagcagtttaaaacttatccaaattgctctatggaaaaactcattatttttctaattaaattcatatatatccagtgggaagaaaaaaaaagtcaaatacaattttaagaaataacaattgttaattattttgcgcacaaagtatttggtaaaaagtaaatcatagctagaacaagaacaaaactcaagttattttaaatatactttagtaattaattattgtgccgtcctattcttagaatactcaagtaatttaacgtagtggtgaaaatttgataaattaattatatactaatttttcagtcttattttatgtggtatatttaattggagatgaaatttaaaaaataaagacgttgaaatatttatcaaattacatttttaaaaaagtgaattcaattttttctctcctcataaatgtattagagtattatttttaaaattaaatagaactaacaatgataaaaaataaattgtatctttaaatatttaccatataaaaaatgtgacactcttttttaaactgactaaaatagaaaataatgtcatatatataaaataaaatgaaaaaagtaaatatcaatttaaaactttaggacaatagctactttgaattacgtagatttcaataaaattgcaacatatataataaacatactaatttacaatttttaaaataatatgactaaaagtctaaaaaacaatatataccgccgtcacctagttactttaatttgtgtagcttctagtacatacatactggtagaaataggtagctcaattttaaatttatctgaatttaatattttaattgtattaaatttataaaatttaaattgacgtaatagaatgaagagagtagtactatataaaccatgtgagtactaacatgatcttcatcttattcttgtttttatttatagaaacaataaaatagttataaaattaatcaatcatgtgtatagtagtgtttatttgggaagcagatagtagatattcattagtgttattattgaatagagatgaatatcataataggccaacaaaggaagttcattggtgggaagatggagaaattgttggtggcaaagatgaagttggtggtggcacttggttggcttcttcaactaatggtaaattggcttttcttactaatgttttggaaattcatacacttcctcatgccaaaactagaggtgatctacccgttcgatttttacaggtacgattaaattctttatatattatacgttaatatgtttgatctttcattttggttttgttatacgaaggacgagacctagaggtctttaagacaaaacataaatatgcatcatagtcataaactttcaataaatattcaattttgaatatgcgctttcaaaggtattacaagttgagtactaaaggaattgagtttatcaagattaaattttgaatttgattcttttgatcatgattaatagtaatgttaaatcttgtccttattggagtatatatatgatcaataaatcaagattttaaattgtagtataatcttaattttaaagaatattaatattgtaaaattttagatttaacaaacacaaaaatcatatttgtatgttataactatagtttgtatagttgcgctcaatatgtttgttgcggctgttaatatgtatatttcggtttacatatacaaaagaatcaattgcataatttgtttcgatatacatattaacatatacaaaagaatttattgtgtaatatatctttgtataaagcaagaaagagcgaaacacaacagaaaactggatagggaaatatttatattttgtatagttataagtgtatatgacggaaatatacgtaattattttttatacatgattttctctcgcttttatgcaaacacaaacacaatttatacatttgtttttgtgtaaagtgagagtggcgagcgagattctatagagagagaaccaaatgaaaatatatgtattatatgcagttttctgtagttttatacaaatacaaacacaatttatacatttatttttgtgtatgagagaggcgagtgagattctctggggaggaaaatatatgtatatatacagttttgtttcgctataaacaaacagaacacattttatacatttgtatttgtataaaacaagagagacgagggagaaactgctcaacgagaaattcaggaagagaggtgaatgacaactatttgttacgagttgcaagtaaatcaaactgcgactataacatttagtttgaattaataatttgttattttaaacgattttccgtaaaatttaattgttaattgcagagcaacaaaagcccaatggagtttgcaaaagggctggtgaatgaagggaatgaatacaatgggtttaatttaattttggcagatattgaaagtaaaaaaatggtatatgtaacaaataggcccaaaggagagcccataacaatacaagaagtccaaccaggtattcatgtgctgtccaatgcaaaactggactctccttggcccaaggtaagaattctaatgggcttttttcgatcgatatacataaattatacaaatgatatgcttttggttgttcatttcaggctcaaagactgaagttaaattttaagaaaatgatggatgtttacgaagtgaatgacgagaaaatctgcgtcaaagatatgatagaaaaattgatgagagataccactaaagctgataaaagtaaattgccttgtatttgttctacggattgggagttggaacttagctctattttcgtcgaagttgacactccactggtaattcataccgcgttataactaatatgtttgtttgattttaacgtactcaaacgatgataaaggttaaagtagatatacaaacattttaaaaataattgaaatagttcaataatagaagtgtacatatcattaacatagtttgatgggtttttttggtggtgtgaatatgtaggggtgttatggtactagaagtacaacagcattgacgattgaagtgggaggaaaagtaagcttttatgagttgtaccttgagaacaacatgtggaaagagcaaattgtcaactatcggattgaaaaactccaaatgcaataaatgtttttcatatgttgacatatctaatgttttcattttttttttaattcaaataagattttttcttcaaaaaattaaactttttgtctttgaatggaaattgttattcattgtatttgtaaaatgtactacactacttggaagacataatgtatgtttcgggctcctttgttttagcaacaattttagactttcaaatttgaggggtctcatttattttagcaataataaataattttttcgtatgaagaatattaggtatgatttgccaaaaatggaattatattaagagaaaaaaatattagaaggtatttgatatacctagagtagtacgtcgcaagaaagaataaatgtattagttaggtaaattattaattgaaaaaaccttattaaaaaaatctgaatatagaaatatatagttttatatcgatttgatctcagatcaattgggcggttgaatcgctactgaccattgcacgtaagataaagatataaaatattataattgattttgctagtttgcttaataagaatggtaatttcagttgaaagaataaaaaaaaatgctttgtgtttttttgtgaaaaactaaattttgattttttttttacagaaatggcccgggtgggggtgggacgtaaaaaatgaaaaaaatgcattcaacaaaatgcatcttgtaaatcatataggagtatatagataggaaatctaaacttatcatcgcgatttataaattgcatcaaaaatataatttataataaatcacattcagttataacatgcatgttcgaattgtgacctcttgatcactaaacagtttaatctaaactatatattatattaaaaacatctaaataaatttaatttgactaagttcctattgctccaaattaagccactagacctaacaaaaactccataacttcctttggctcacgtaaagagtacaacgccttggtgtcttttggagcagcagtaacaacaattggaaaaccttgtcctcttttcagcaatacctacaa

SEQ ID NO: 322 - DNA, 3729 bp, Solanum lycopersicum
aataatttttctatatacaattgtaggttgtttcgttgatcccaatcgtatcattcccttttaaaattaaagtggttttagaaaattcctatttggatgcgatattttgagagaattgccctaatttaatataatcaatccccctttagctgtctttaatttattatatgtttttcaaaaaagttaagaattaattaagcatattataaatatatgctgactaataacgtggaatttcatacagacaaaccacacataatatatatggtcaacaaaatggatattctatcagaatcaagtcattatcaacctaattggcatcttaagtacaaaaacaaaagctactttttagtttttgttgctattaacttaacggaaatgtttaagtagcttttgtagtactaattattctgctagatttcctcatctcagattatactcgtctaaaagaatcatttccttatttgtactttattataattaaccttaattagttctgtcacaaaatcatacaactcagaatttactcttccttaacatagtgtctcttgtttgtacatccttcatttggttagtggaacaaagatatatatatggagtaataatttcaggatattttataagatcatttatcttatgtttaatagtgtgtagtatttagttttagaatgatctttctcctattattttaataaaaattaaatgacatcacacaagatggatataattttatgaaatattcttatctatgttatcccaccaatcaaacgattctttagagtatagtttttatatcatttttgtaatttcccactcaagccaactctatattagtttccgtttatattatttgaattcttcaaaaatattattgagatgtctattaaatcttttaaaagaaatcaaaacgtcaaggcgactatatttttgaagagtacgatcaacataattttttcagatgctaaaaccataaatttcccctcctccatcattgaacccccctctgtccttccccccaggtcccctttttttcctttctctctctcctttatttctcttttcataagcatattctttctctctctagggttttcactttcacctgaaatagtgttgttaaattgaatgatatgttaggatcctttggttcttcatcatctcaatctcaccctcatcatgatgaagaatcttctgatcatcatcaacagcgtagattcaccgctactgctacaactatcaccaccaccaccatcactacctcaccagctattcaaatccgccagctactcattagctgtgcggagttgatttcgcagtccgatttctcggccgcgaaaagactccttactatattatcaactaactcatctccttttggtgattcaactgaacggttagtccatcaatttactcgcgcactttcccttcgtctcaaccgctatatatcgtcaaccaccaatcatttcatgacacctgttgaaacaactccaactgattcttcttcttcgtcatcattagctctaattcaatcatcatatctatctctaaaccaagttacccctttcataaggtttactcaattaaccgctaatcaagcgattttagaagcgattaacggtaatcatcaagcaatccacatcgttgatttcgacattaatcacggggttcaatggccaccgttaatgcaagcactagctgatcgttaccctgctcccactcttcgaatcaccggtactggaaatgaccttgatacccttcgtagaacaggtgatcgtttagctaaatttgctcactcattagggttgagatttcaattccatcctctttatatagccaataataaccacgatcacgatgaagatccttctattatttcctccattgtactactccctgatgaaaccctagctatcaactgtgttttctacctccaccgccttttaaaagaccgcgaaaagttaaggatttttttgcatagggttaagtcaatgaaccctaaaattgttacaatcgcggagaaggaagcaaatcataaccatcctctttttttacaaagattcatcgaggcgttggattattatacagctgtgtttgattcactggaagctacattgccaccgggtagtcgagagaggatgacagttgaacaagtgtggtttgggagagagattgttgatatcgttgcgatggaaggagataaaaggaaagaaagacatgaaaggtttagatcatgggaagttatgttgaggagttgtggatttagtaatgttgctttaagcccttttgcattatcacaagctaagcttcttttgagacttcattatccttctgaaggctatcaactcggagtttcgagtaattctttcttcttaggttggcaaaatcaaccccttttctccatctcgtcttggcgttgagaaaaactatcaaatagccaacttcagagggtaattaagactactgatagtttaggagggatctgaagaaaacgcgtggagtgaaaaccctaaataaccagattttctaatgaagttgtagtagtagaaatttgcatggtgaagaacaatattgaagaggtattgaaatttcatgttttttttgttttacttattgatatgaatgttttaaaatttttaacatagaggactaggttgatgatatatagtatttaagttaactagtctttgtataacgcaagatcttgatcaacttatttttatttttaattatttgttgttgttgttgttgatgatgaaagattctcatgttattaccaaattgttaggtaagtggcactttggagtgggaaaatgatgtatattccaattaaaggtgttaattaaccctaccatattgtttgtttgtattagtaatggtggatagtttcattatctttcactttataatgctaatcatgcttcaccttttcattttagtactttagttgtagactatagagaacattttaattttattttattgtatatgattccttatcaaagtctttatcttgttgcattttcttattttactttacaaaagatttctggtattaatggaaagtggtcacatttggaaaaagatatgggggccaacaagaaagtcattttctttgtcgaaaacaattgatttcttttgagatacgataacactattaattgattaatcatctgagaaatcaaaaaaaaaaaaagttgtataccccattaccactattgtcctttccctaaaatttcttatatatatatatatgagtttttatttttttttaatggaagaagggggaggatgagattcttgaacatgcatgagaattgttgttattgttttgtgtctttgaaataggaccataatcaattgccctaaattgtgcccaattgtcccctcaacaaaaccatcaaagttgtcaaaatagggttattcttgttacccactttgccccccacccccctacaatgggatctctctcgtgtctagtgtttatccctaggaccacctctcttttaatttaaactttttacatctttttaagctatcattttttcataaattttttagatgaaaatttacttcaaatatattttcaagtttccagaaactgaatcagacaagtttctggaagaaattttacacaactaaaacttcaagtttcaaagtttcaacttgaaaatctatgagaggtgattaagtttctctttataccatgccttgtatgatcatactaatcag

SEQ ID NO: 323 - DNA, 7570 bp, Solanum lycopersicum
  modified_base (692)..(969): a, c, t, g, unknown or other
tggaaagtattttcaaaactttgttcaagtataaattattgttataatataaatacaaatatttatcaaattaacaaggtattcaaaaattgactctccaaaagtaattcttttttggatactattttaaataaaaaatatttttattttgatagtttaattagctaaacaagacataattaagacttgtcttagatttaagttccaaattactcccatttttttcttagatttaggatttttagaacgtgaatataaaaaaaaaattaagtgagaattgatcgttgtttctctaaaaaaaattacttcgcaattcaaccaagtacatcattcgatccttttggaacatgtaagtttaatgagaaaatattatattaattcgacaaaaaatgtatacataaaatatctaatttaatagaaagatcactatttcacccacattattatttttgaaataaatacatcgcactaaccccacataaattaaaacgaatgaaatagagagaaacaaaatcaaaaatataaatacaaaaaaaaaaagtgggttgtactatttccctttttaaataagatgggatctattgctttattttttctttttcattgttgtgaaatagtaactagggtttgttgtaagaggaaatataatatcagggtttccataattaggtcatatttttttttctctatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttataaaaaaaaaaaaaactttttttgaagatgggaagaggaaaagttgaattaagaaaaatagagaataaaataaatagacaagtaacattttcaaagagaagaggtggattagtgaaaaaagctcatgaaatttcagttttatgtgatgctgaagttgctttaattgttttctctcaaaagggaaaaatctttgagtattcttctgattcatggtaagttttttttttaattatgtaaatttatttattttgaatttatcttttaattgttcttatgttatatataatagaaaaaaaaagaattccttttgtatgaacaagataatgtttgtaatatatagttaattgtggaagaaaattttgatctacttttcttagaaagaggtcttgtttttttttaaaaaaaaaaaataattaatttccttgatatttttatgtaatttagtaggaataatgaaagaaaatgccatctttaatttattaaaaagagtttctactatgaagaaaataatcctgcaaaataagtgtgtgtctctttaattatatgaaaaaggatgatataattgaaataatatttgtaatagttaattatggtagaaaaatgattttcttttcttagtaagttttttttttatttttttatagtaagttttcttgactttcttgtttcatttttaaaaaaaatttaaaattaccttaaatttgatttcaagaatccatcttcatttttttaaaaattgttttcctactatggaaaaaataattctttaaatatatttgtgtgtctctatatatatgaaaagaatgatctaattaagtcaatattttgtactagttaaaaaaactaattattgaagaattatcttgagtttctttgtttcttgacttttttttaaaaaaaaattatttgatatttttgtttaactatgattgcttgacttagactttcaagatcacttcttcattttgttgtactaatttatttcttttagtaggaacaatatattatttattactcttttttttttgtgaaatgaagaaaataatcctacaaatatcttgtgtttccttttgtaaaatacttgatataactaaaataacatttgtaataacctctaaactaattatatatgaaatatatttgatatttattttttgaagaatttcttgagtttcttcttgctttattattgtttattaatttcttatctttaacatagttctttaattttaaggagttctttttcctcttcaattttttaagaattaatgattcataaagaactcaattaaatattactgtaagaatattttaaggttcagtaatcatttatttctgaattaattagttcatttttttgttttaattattttttttctttgtttatacataggaaatgacaaactggaaattctgcacctaggacttcttctctagcagccttaaatatttcaacttccaacaaaatcataacaccaaaataatttaattaaaatattattcacttctcttaaaagtaaattttttcactttatttgaaaatttagtaaattagtgttctgtcacaagaaaatttaaatcttaacttgaaactgtgtagaatttattttcaacacaatttcaatttctatatatcatttttcaaacttcaaaataccacttttatggggggaaaaatcacataaatcatatccatacaccaattacatgacatatttaaaaatgttattattattatataactattattattattataataataataaattatacatttcaagaatcttcatatatttttcttctaattttgtacagctattaacttatgccacgtaaatctaaactagatgaacatataccctagattcttataaaataaaaaaattaataaaaatagaagaaaaagtacactcaaagattatttgtttgttgtactctaaaaatacattttccaagaagcatctactgatttcataatcctcattgacttttgtagattcactaaccggcaatgtacatatattatttgttgcgtgagataacgaataataatttaaaacgctttttttgaatatataaaaatgatacttagtaggataatgaatcagtatcgcttagtttgttgtatttaatagaaaatggtactcatattgttaatgttatgatttactatatgttgaatacattatcgattaaagattaagggtattttatttaacgtttgattgatcggataagaagtaaatttattatatgtgaactttcataatatgttatgagttattttttattttagttgaaacttttaaataggaaaaaagaatattattgatgattttttttttgaaacagtatggaacaaattcttgaacgatatgaaagatactcatatgcagagagacgtttgcttgcaaataattctgaatcaccggtatgtatctaattataaaagtttttttaataaatattttttgagtttaagttatatacgtatggttagtgttgttcgaatgatattttacggtaagctttgaaaataggggtttgattaattttgaaaagaagatatgttatctgatacgatatgtaaaatgatgtgatgtttcatattgtatttatggtattattttatttgcttcggctattatattattttatgttgcttcttatcctttcttttttttactttttgatatttgtattttcttttcaagcgtaacttggttttgaaatgttttacttatcgatatgagttgtgatgcaatcgtgaaactgtttcaccttaatcaaaagtctcaggttggagctctggtatgggaaaaaacctattgggagcatcactcccaaaataggcatgcataacgcaatcgaaatttaatcggagctctaatataggctccgaacaccaaatgaaaaactaccacaaaaaaaaatgcttcttaaactgagttctatcgtttaccgataacagtctctatttatataccttcacaaaatttgaataagatttatatctccgtcgaacttatttatataattatattgaatatgttatattggtttttttaggattaatgcctttcttttaatcttatagatgatttattggtatttgtataatttaattaataggtgcaggaaaactggagcttggaatatactaaactcaaggctaggattgatctccttcaaaggaaccacaagtaaaatatattatttcttaatttcatccaataatatgctttgttgatttagggtatgtttgttatagaggaatttatttttcttgaaaagttattttagtttttttccatacgtttggtcggtggattcagaatttaaagtctataggtttaaattttgattactcatttttcaagaaaatgttattctttataccaaacacacccttaaatagattattttttaaaattatttttttaggcattatatgggagaagatcttgattcaatgagcttgaaggacttgcaaaacttggaacaacagcttgattctgctcttaagctaattcgatcgagaaaggtaatttgtttgacactgaagcgtagttattattatgtttttatgctatcagaagcatctaagggtctttgattaatagtatggacattatatgtgtcatgcttaaaacttacaaaattgataaatttgttggctactttgtgactagatcatagcaatgtattagcttggattctttaaaaatatcggtgggtgcatactgaatcctttaaaaataatatactttttaaaatttgatatgaatgtgataacatttttgaataatttgaacaatgtcgttagcttgatagaccataacttttttgagtggattaccatttgctttctttcttgcaattttttgaattttatgttacatataaaatgtttgtgttgcagaaccaactcatgcatgaatcaatctctgaactgcagaaaaaggtattattttatatgttttatattattttttttagtttgatctaatgaaaatggtcttttatcttagaaggtattgatgagatttacgtatatagtttatatcctcacgaaatattacgttttttagtttgttcaagtaaaaggtcaagacttcttgatcagaaacaatttaaatttaaacttcttgtttcatctttgacgaaatgatttataaaatagagatcgatgtttttgtcttgttttagaccatttaaaaaatctttctttatttcttaaatttcttattcgttcaaacactgttacataaatcgaaagctttggttgattccttttgagtgcaatgttttcacaggaaagagctatcctagaggagaataacatgctaaccaagaaggtgagttttttctcatgttattttattctacatgcattacataaatacgtcatttaatttggttttagctggtatatgtgatgaataccaactttaggtcatgtgaataagtagacacttaaaatgtagaaaaaattgaacaagtagattactcatatattctatatgatataatacacgtaaaatattacatatgacgcaaattccgttattcttatttaaaatagaatttaatgaatcatattaactagttattatatgtttaatttgttctaaacagattaaggagaaggataagatagtagaacagcaaggtgaatggcaccagcaaactaatcaagtttctacttcaacatctttcctcttacaaccacatcaatgcctaaatatggggtaattttcttcctctataactaaataaacaaactcagtccagaatttttatttagcgtattcaatattataactatatatacatatataaaaaaaaatatcagccttgtacatgtagcgtataatttttccaaggaagggagttcattatttgtcttattcttgaaagttatatatatttacttccatgtgattataaagcaatctttttgataaccgagaaactaagtatgtatttaaccatatttcattgtgaaaatagaaaaaaaataatttttaaagtgaaaaatataatttttagaatttatgaccaaatattttttagaaggtgaaaaattttcatgatcaaacgtcactaagtctcaaagggataggtgactcatggtttttagtttgttaagcattaattacttgtttgattgtttaattaatttctaattaattgattttgatttagaggtaattaccaagatgaagtagcagaagcaaggaggaataatgagcttgacctaaatcttgattcattatatccactttacaacatgaataaacatctatgaataatttcactctttgctaatcgcttgaaacgttgaaaggagctcactatcaggacagacaaatgagtataagcgattagcgataaaaactctatgcgagaggaaattatatatgatgttaattaatctatgcttgagaaattcttaattatatatattgagtgtctttatattgatatgcatgtatagaaccttattattatgaatttctatgtattaatgttttaagtatgttaaaacttaattgtaaatggaatcaagtccattctctttgtattagaattgttgttgacgtgtcgtcaatacaattatggtttactattagtaattttgtggtctcatttaaaatggctttttcagtacttcatataatttgtttttttttgacaatttgatattatatgaataattatcagggtaatattttttttgtattattctttgagtttatagttgtagaatgagcttcacatgtctttgttaatacaatagggaccttttatcagtttaccaacatgggtttcatgttgttctgcgcggatgaaattgttcaccctcaataaaaggtttcgaattcgaaatctaaatataatgaaaatcttgttgggagcgttatcccaaaatggaacctattattctaatgtggactccgaacgccatgtaggaaaccaaaaaaggggatctgtttaaaagactagtagctttagaggaatgatttctcatgatcattcaactaatagtgttattatctcgaaaaaacacgaacgcaaacaagatagcaataaactttagctttatgccattaatcttcaagttgtaaaggccacagtgcaaaaaagacagcatatactgataacttgaataatctaaatttcagctttatctgatcaagggtagagacacaagagtttgggactatccaggtggtgaagaaccgcggacatgcctgcaatgagcagagatctcactcacgggcctaaacctcatgaacaaacggggtggactcttctcccgtttagtacaactgcacaagtagttggtggtctcacgagttttcaataaaacacccacaaagtagcccatggcagcaaaagttaagtatcgaaaagaaaagagttcaacgagaaccaaaaattctctagactgtatatcatgttactcatcgatccatcctttgtagatgtcagggtaccaaagtgtggtaaaaaattatgtacaccttactaagagtatgcaggaaatcttcacatctacatctgtttttcatttcatctaag

SEQ ID NO: 324 - DNA, 6923 bp, Solanum lycopersicum
tgaacatacaattaaggtataatatattttcattttcatttttagtagattaccaaataaattttatgatatatttatcttacaataacatatttaacgtatttttacagaatattaaaaggtaaatatgtatacaaattctactcatattaaataaaataaagttttgtttttatactctccactcaattatcaaaccttactaatcataataaaaagggaaacattcaaaataaaggaatcaagaaaaaatattaaagcaaacaagaaaattcatactaaaaacacaagcatctatgacaaagtaatatgataatccaagtgcaatatataacaaaaaaaaatagaattacaagaaatttctcgataatattgtgactcgtttggtttgaattcatatttgatggaattaattatgatgaaataagttatgctaagaatattttttattgactatttggtttgttgtattcaaaataataaatcttctaaacaacatatatgtgtacgagaacacccttcatgaatgtgagaagtaatatataaaaagtgtttaaagggatatttttgtcaattagtcattttgtccatggataagttatttcagaattattataccattcaagaaaagaaataacttatatcggtactaattattaattgtaggatcctttaatactagaaattttttaaaattaaataaggacatattaggaaaaaaaattattgtcctttcttgatttgttaaaatagacaagtaaataggaatagatataaaagaatatgtggtcacatgaataagtaaatagtgatagagggagtagttaacaaagtaaaaatagtttatatttaatggggctagaggataaatttggcggctatttatgtaaagatacctgcacatccaaccgattcgtaattcgggtcacacagcccaatgtcgtcgcaatataaaacccttttagctttgcacatatcccgcaaaaaaaaagaaaaaaagaaaaagaaaattcactgaaaaataccgttccctccaattctctacaaaccctcgtaaaaatccccaaactccacaaaacccaaaccctcacgcactcaaaacagaagaagaaaaatcttaaggcaattcttgaaattgtttaatggggaaagacgaagatgagatgcggggtgaaattgaggagaggctgataaacgaggagtacaagatttggaagaagaatactccttttctttacgatctggttattactcacgcgcttgaatggccttcgctcaccgtcgaatggttaccggaccgggaagagccgtcgggaaaggattattccgttcagaagatgattttggggactcatacatcggaaaatgagcctaactatctcatgcttgctcaggttcagctgcctcttgaggatgctgagaatgatgcccgccactatgatgatgatcggtctgaatttggcggatttggttgtgccaatggcaaggtttgaatctattctgttttatgccttgtttggctgttttatatgggttttcattttctggatgttttattttactacatttttctggctaatttcagtgttaacgtctgagatttacttgttttgtactagagtttagttgttctagggcagcctgtttaagaatctcttgaattttgatagctttgggattatgttatatagtaaatggtttaaagtttattaacaacactataacaagtaaccagtgtagtcccagagggtagtgtgtacacagacttactcctaccttgtggagttcgagaggttgtttacaatagaccgttggctcaaagttttctcctttgcagcgtaggtactagggagttgtgaattggaagttgtcagttcattcatggattttgctcaaggtacagttaatatttcatcaaaaattcaccaaaggggaaaaaagggggcctagcataattagtgcaccattttctgacccaccaccacaccaaataagggcacctaataggtcaatccctttgggcagagtgaactctttgactgacattttcttattgaaattttatgcgttgttgtagtttttattattcctctgcttctttctctgtcctgatattgttgaaaggttctcttcataaagggcacttgaggcttttatatcatatatgaataatgatgcttggaccccaaatcagtagtgatttgctggtagcttaggtgaaatgggttgtaacaaagccaatgcttcctgattcggctagcgttctaaaactaatggtttagttgctccactcatttgaatgtgaagatgattggaagcaacattgctgcaggagaaaactgatgaagttttgaatagtcagctagaactttaaaaagcttatgagaataccacttatgactatcaccttttagtgtagattgatgtcacagatatcaaaggtactatccacatagagtcagtgataaattgataatgaattcttctatttatgatgagggcatggaactgtaaaatcttattctctaaaaaggttttaaaaatggtctgtcagttccaattatcacttgaaggccttactctgatatctttttgctgtactattatttcccataatatcagagtgaatttcttgtctctgtttcaacattgagtggcttatgtataatgataaatatttctctttcaggtacaaataatccagcaaataaatcacgatggagaggttaatcgggctcgatatatgccccaaaacccatttatcattgcaactaagacagttagtgctgaagtatatgtttttgactacagtaaacatccatctaagcctcctctagatggtgcatgcaatccagatttgaggttaagaggccacagtacagaggggtatggtttgtcttggagtcaatttaagcagggtcatctattgagtggttcagatgactcacatatatgtttatgggacattaatgccactcccaaaaataaggctctagaggctatgcagatatttaaggtttgcctcgtgtttttttttctgacgagtctgcagaggatagatattgccatgttacactgcatagattatcaatttgttgcacccacttactacttgtagttttatcttgtgcaaataaccataattgataattggagaagaacttgtatgctttcccttccagcaaacacccccaggcacctcgaagtaaaaaaagatcaagcgaagcagaatagcatgagttctctttattaatatcatgttacaaagttaaactgtaacttcaatagtgtcccaacttttgtctcaaaggatatttttggtatcatcttctctactatttgctgtctgaagcttcagtctacctagcatggacaagaatcttgtctctcgtattattttctcattaagcttttgtcagctgttgttggtttattctaatatttaaaatgtgtaggttcatgaaggtgttgttgaggatgtagcttggcatctgaggcatgagtatttatttggctctgttggggatgatcagtatttgcacgtatgggatctgcgaactccatcagtgaccaagcctatacaatctgtagttgcacatcaaagtgaggtgcggcttagacttcttagctggacttttccacgtttatgtagttaataatgcttcccttttgactggtgtaagaaccactcagatatgtcttcttaacattgttggcagtcttttgattttcttgcacagaaatgtgaggatcttgtgcttacaaaataattatagtttttcttgaaactagaattagtgtttcccaatttttacctgtacttttttttcttttcattttcgtgggtttacattattggatgtgcaaacaagtgattgctgtgtgtgtaaactataatgtgatgctcatgtctggatgaatttctgtttcgttttaaatggtttaaggagaagatcctgccttccatactctctgctgattattaaatgtacaatatcatagaaggatgatcattactgcacatggcctattatgaaaaacatttctgaatgcagttatctagattttttgtgaacaagcagtcttgtgttgatgattgtacatgattgacctcctttctcttttgatcaggttaactgcttagctttcaacccctttaatgaatgggttgtagcaacggggtctacagacaagacagttaaattatttgatctacgcaagatttctactgcacttcatactttggattgtcacaagtaagatgtcttccttacatatacttttgaggaaaatgttggctccgtcatcattcgtgttaaatagtataatagaagcttgttcatctgtatttacagttgcttatcattaatttccttgcaacttttctgcagggaggaagttttccaggttgggtggaatccaaagaatgaaaccattttagcttcttgttgccttggtaggagactcatggtttgggatctcagcaggttactcttccaactatccttactagtattttcataatatcagagtgaatgttctgtcggtccagtgggtgcttttattctatcttgctctttgatgttttgaattttaattattccatctataagttaacacctgccttatcttgccagctatagttcacctagagttgtgatctatcatctctattccttccctcttctcccacatggcgtcaatccctgtactccttagaaaactatcccatttcattgtttgctactgcccatttatttggaaaaacaccttttagtcctagattagtattttggcacttcctttataggttgcaactttgtcatctcactcaacatgtgatttggaactctgaaataggctcattctgttgtgtgctcgagtcaatattgtactgaattgtcctagcatgtgaaaatgactacgtcatatgctctactgagttttggcatgtgtagaattgaagttccatgttgatttgtgcacatgataatccagatgtacaattatattatcatgtggtccgaatctgagtttctgatccaagtctcagtatctgggattgcacttattcactgaattgttttggtggtatcaatccattgtttctcctttgtgacaacttgtgtattgaagttggactttgacattagagatatcattgcgttaaggatttgaaatcatgtactttaaaaggaacttcagttttaaccagtgatattttcttgtgtcaaaaaaggccatttctgctcagtgatacatttaacatctacgcttgaatgccacatctggcgttacatgggatttattttagatgattcacagaaatcactagaggttttatatataatgttccctttaagatctgcaggctgcagtaaacctgagatttcacttttttaaaatttgatttaggatcgacgaggaacaaactccagaagatgcggaagatggaccaccagagttgctctttattcatggtggccacacaagtaaaatttcagacttctcatggaacccatgtgaagattgggtcgttgctagtgttgccgaggataatatactacaaatctggcagatggctgaaaacatctaccatgatgaagatgacctgcctggagatgatgcccccaaaggcccttaggatactaatatagcccttaggagggtattgtaacatcaactaggagaggctaaaaagatgcttgttctatttgcccctctactcccccacattgttgcgttattttttcttttcgatttttccttttgaactgagcttctctactactgtgatgatatctatgactgttactttaacaactttgtttttctcttttaacatttcatttttgtatttagatgagaaaatattgagcccatagttgcttttttcccaattggcaaatgatttggccagctttatacttttctagattctatttctttttttcctccatagttggctgtgattgcttaaagatgaaagcaaagttcatatgagttgatgatgtaactttattctcataaagaataggattgtgacaggctaggctactaacatgggcatgtgagcttaattgtatgctttaatatagggggtggtggtgatctattccagtccctcattctgtaaacctgcaatagtttcacgtgagagacagttaacagattaacccacaaaagatggagcactgccaaccctatctgtttagccaaaaaaatgatctttcgtttggtattgggacaaggaacaataatatcgaaataaaatgtagattgattcgtttatatcatctcaaaatcgagataactttgtcaatatttcttcctttcttttattaacttgtctattttaacaaatcaaaagagatttttatccataccaatttatttagtattaatctctattaattagtgagacattaaattaaggatgaattaaagataataaaaaataatcttatggtaaatgctacttgtatatttcgtgatatttctttatgcattgcatatacagtcgattaaatcttaaattattttttttgatcattactattctcggatcgacatatatgtacatgtacaatttcgtaaggtaattactgaaaaataaataaatctcgcaaaacctaataaagtataattctttttaattacgcaatgtaaagcgtacgtgatccacctcattaagtattacttgtaaattaataatttatatagttgagctaaactaaattatacgtgtggtaagtatgttgtcactgtggatgtgtatcagatattaggtaaaattatattctcaattcagcaacattcaaccatcaattttcgtaataaaatgagttattggacttataatttttgaaatttaaagttatttttatgcatgcatgttacttgaataaaatcttaaattctat

SEQ ID NO: 325 - DNA, 4954 bp, Solanum lycopersicum
aaaacattataaaaggtgtgaatcaacaacacaggaatggtgagggtgtgtgtctctcaactgctgccaaaattaaattagctgaaccaaatcccaatactacccgacgttcagggaattaaaaacctactacctgcaattttcaatattttcactccatcgataataattacgtggtatatatatatataatggttgagatttaaaatctgtttggatctagttgttttaggcatttttatttaaataacatttaaatatttttataatatcaattaaatatttttaaagttaaaataaattaactagattgcaaattgtcctattttttccatattgaaataatggttgcgcaaggaagcgttgaaatatttatgagttcacctgtattcagtgttgaaatcgttgtagaaagcaagtaggactctatagcattgtgactttttttaccaaaactaggttcattaatttctactctaacatcgaatttgagtcatggagttacttgaatcaatcaacagtattaaatgtgcttcatcaatattactaataaatactatcacctatagaggcattatcaaacatgtatgtatatatgagaagctttctagtacaacaattttcttcgtaaaatttattcgcatcgggtatttatactaagtcaatacatgcatatcatttgtttgaatttataatttattttacttcattaaatctagtaataatgaaaatcgcatcgaattggtataaacatccgatacgagtaagtgtaaacacatatacacatgcaaaaacagtggtggagctataatttggtccaaggggtgtataaatataaagaaataaaatcgtgtagaagtcaaagactgtcagtacacccttcactgtggctccgccaccgtgcacaaatattttagcacatgtgctatttttatgctacacatagtatatgtgctatttttatgctatatttatactacacatactaggtaggtacatagttgatttatttaccattctatccctaggaagtttctcttgtattactgatatacaatacaaaaaattttctttatattctttcatgtttaacatcttaaaaagtaattgagcagaacaaataaaatggtttcaatattgagtaacatagggatgatggtggtcaccttcaagagaccatcattatttacctcactccgtcgtcgctctgccaacaacattattattactaagcactcacatcctatttccaccacaaggcgttcagggaattacaagcctaccatgtgggattttcaatttattcaatccctacacaatccttatgaggtacatatacatacattttctatacattatattcacgtcacacgtttattcatttaatttataaatgtgttgcgtagggagacaagtatatgaagcgtttaaacaaactaaaaaaagaagtgaagaagatgatgatgacggtggagggatcacatgatgaagagttagagaagttggagttgattgataacttagagaggcttggagtgagttaccactttaaagatgaaattatgcaaattatgaggagcattaatattaatattaatatagccccaccagattcattatataccacagctttgaaatttagactcttgagacaacatggttttcatatctcacaaggtacaatagtactacttggactcttatttcttgttcattcatgttttgctctacgtacgcagtttgtttttttgagccgcccttcattaaatctaaggaattttttttaaaaaaattagcaacaatattgtaagaaatagaatctaaatcaactcttatatttttttgctctttgtgttctagatatattgaacgatttcaaggatgaaaatggaaatctgaagcagagtatttgcaaagacactaaaggtatgttggaattttatgaagcatcatttctctctacagaaactgaaataactctgaaaaatgccacaatattcacggtgtcaatctaattatttttcaatacttttttgaacatagattcttcaagtttattttttattagattttgacttatgtatattattgtgttttttagatatattaaacagttccaaggacgagcatgataatcttaagcagagtacttgtaacaacacaaaagggttgttaaaattatacgaagcttcatttctgtctatagaaaatgaaagctttttgagaaataccacaaaatccactttggcacatctaatgagatatgttgatcaaaatcgttgtggagaagaggataatatgatagtggaattagtggtacatgccttggaactcccaagacattggatggtgccaagattagagacaaggtggtatattagtatttatgagagaatgtcaaatgctaatccccttttgctagaacttgctaaattggacttcaacattgttcaagcaacacatcaacaagatttaagaattttatcaaggtacgagaaaacatatcttttaagtgaatacaaattaatttcatattagttttgatgtaaattgtttaattaggtggtggaagaatacagggcttgcggaaaagcttccattttcaagggatattctggttgagaatatgttttgggcagtaggggcattatttgagcctcaacatagctactttcgaagattgataacaaaagtcattgtttttatttcaatcatagatgacatttatgatgtttatggcacacttgatgagttggaactcttcactcttgctattcaaaggtaattataattctctatcgcaaaataataacaaaattttattttctagtaacaattagtaaaaattcagatgggatacaaaagcaatggagcaacttccagactatatgaaagtatgttatcttgcactcatcaatattatcaatgaagttgcgtatgaggttctcaaaaatcatgacatcaacgtcctaccctaccttacaaaatcagtaagattcattctccttaataaatgattttttccccaaaatacccctcattttttccgagacgaattcaatatttaatatgtcgttaattagtgggcagatttgtgcaaatcatacttacaagaagcaaaatggtaccacaatggatacaagccaaatctggaagaatacatggataatgcaaggatctcaattggagtaccaatggtattagtccactcattgttcctagtcacaaatcaaattaccaaagaggccttggattccttaaccaattatcctgatattattcgatggtctgctactattttccgtttaaacgatgatttggggacatcttcggtatgcttttaccccttttatctcacatatctagcaaaatctcctctatttaatttaatttatttacttttgtatcaattcaggatgaactgaaaagaggtgacgtttccaaatcaatacaatgttacatgaacgaaaagggtgcttccgaagaagaggcaatagaacacatagaatttttgatacaggagacatgggaagcaatgaacacagctcaaagcaaaaattctccactttctgaaacatttattgaagttgcgaagaatattacaaaagcatcgcattttatgtatctgcatagcgatgttaaaagtagcatctccaaaatactttttgagcctatcattatttctaatgttgcattcgctctcaagtaattttattttacgtaggcttcattttattactttgattttatatatacgtatctccataaagtcgaatttagaatctaaacttttaacgagttccaatgtttaattataaaaaactgaattttcgactatataatgttaatgtgttctttcttattaattgacttttagattattatacatttggatcaacatgtaatataaatcaagagttattcatacaatatatttaaacagtgaaaaaccgtatttggaaatctgtaattatgatttttaagcaacataaagtagaatgcttaccaatatcaactgcttccaattagacataataaaattatcaataaataaaaatcggactagtgcggtaaattagagaaaactttaatgttcttgagtttcaagattaaaattcgagtatgccaaattaaaaaggtactgttctcacaagaggcagctgttagttactaatatattttttttttgggtaaggggtagatggtaaaatgtaaaatattagtcacgtgtattataaaaatttaccccgattagatttattattacccgtttgcttatataaacacttctcactgaatcatggttattagggatattacccaaacacaggtaattcattcaaaattttaaaagttggttttaatataatttggattggattcaatcttaactcattcgggcctaatctatttgaagagaatcttccattcatcccaatgcaatctccaatttcaacccgttttaaaactttttactgagatttgttctatgaattattatctatttaacaatatttatgctttatctatcaatttgttactttttaatagaaattcttgagcgaaaattcatattgtgattataaaagtaaaatataaatatgttaaattattgagattaatcgggtcaaatttggcgattcaagacccaacccatttttagctcaattgagccaaagtaaactagggtggatcaagacctgacctgatttctattttaacccattttaatatgggaaaattacgcaacaaagcaaatttatactatttaattactcatcatagctatagtttgctataattaccacttgcgactaacattatacattaattacgtggactgatttcgagtttgcataattagtcacgtatgtatatgtataattgtaatatacaattatttaatctatatacatataaaattcacctctctcccactctctgccctctctcg

SEQ ID NO: 326 - DNA, 4485 bp, Solanum lycopersicum
tgaataaacaaacaattaacttttatacactcttgtgaatagatgtaagggcatttgagtcattaatagaaaaaagtattttaacgaagcaacccaatgattattttcaaattcaacactcgtatttaatacattacaattttatttattttatataattagtctaattttttaaaatacagttgtcatcacttgatatttatcaatcttttaattgtaactctctctctctttatatattaaatgaattagttataaatgcacatattttcctttccaaaataagatagcaacatggagctgaaacaagctttttgccattttatttacttaactatcatagtgattaaatgagtattttaatgactaaaagcttatacaataaagtaaaaaatctctttagcgggagcatattttatttctatctttatgacttaattattaagtccttaaaatatcaataatttactttatattggaaataaagttatttctttttctaagttgaaacattgaactgtaatgttacaaaaatagtcactccattaaagtaatatcttcttctctagctttacaattcctttcctttctagtgggcaaaaaattcaagaaaacgactaaagtattaactattttttccttttaattttatttgtctgatattgacttaatatattttaataaataataaaaataaatatttattttatatatacatgaataaataatagagtatgagaaatacttcgtctatttaaaactaaaatatgaatactaaaaaattatataaaaaatattaattattaaatttaatcgaactcttacgtaattgtctatataaaaaaaaaaaggagtagaattgccaattaattggcggggccttcgtggaacccgccaggttttgtccactctctttcttcactccctaaattcagctcaaattcacctcaaataaaaaccaaactcaaattctagtcttaacccaaaaaaaaaaaaatactccaaatctttttttagctttcaattttctcatatatctccgccaccccctgttttttctctttctatctatctctccaccattttcacctgtttttttgctgtgtttatggaatgactgaatacagcttgcccaccatgaatttgtggaacaatagtactagcgatgataacgtttctatgatggaagcttttatgtcttctgatctttctttttgggctactaataattctacttctgctgctgtggttggtgtcaattcaaatcttcctcatgctagtagtaatactccctctgtttttgcaccatcttcttctacatctgcatctactttatccgcagctgcgactgtggatgcttccaaatctatgccgtttttcaaccaagaaacccttcagcagcgtcttcaagctcttattgatggtgctagagagacgtggacttatgctatcttttggcaatcgtcggttgttgatttctcaagtccgtctgtgttgggttggggagatggttattacaaaggggaagaagataaagcaaaaaggaaattatcggtgtcatcacctgcttatattgctgagcaggagcatcggaagaaggttctacgggagctgaattcgttgatttccggggcaccacccggaacggatgatgcggttgatgaagaagttaccgacaccgaatggttctttcttatctccatgacccaatcgtttgttaatggaagtgggcttcctggtcaggcgttgtatagttccagcccgatttgggtcgccggaactgagaaattggcagcttcacactgtgaacgtgtgaggcaagcacaagggttcgggcttcagacgattgtctgtattccttcagctaacggcgtggttgaattgggctcgacggagttgattgttcaaagttctgatcttatgaacaaggttagagtattgtttaacttcagtaatgatttgggttctggttcatgggctgtgcagccggagagcgacccatcggcgctctggctcactgatccatcgtcctcaggtatggaagttagagagtctttaaatacagttcaaacaaattcagttccatctagtaatagtaataagcaaattgcttatggaaatgagaataatcatccatctggaaatggtcagagttgttacaatcagcaacaacagaagaatcctcctcagcaacaaacacaaggattcttcacgagggagttgaatttttcggaattcggtttcgatggaagtagtaataggaatggaaattcatcggtttcttgcaagcctgaatcaggagaaatcttgaattttggtgatagtactaaaaaaagtgcttccagtgccaatgtgaacttgtttacaggtcagtcccaatttggggctggggaggagaataataacaagaacaagaaaagatcagctacttccaggggaagcaatgaagaaggaatgctttcatttgtttcaggtacagttttgccttcttcgggcatgaagtcaggtggaggcggaggcgaagactctgaacattcagatctcgaggcttcagtggtgaaagaagctgatagtagtagagtggtagagcctgaaaagaggccaaggaagcgaggtagaaagccagcgaatggacgggaggagccattgaatcacgtcgaggcagagaggcaaaggagggagaaattgaaccaaagattctacgcgcttagagctgttgtaccaaatgtgtctaagatggacaaggcatcactccttggagatgctatttcctatataaacgagttgaaatcgaagcttcaaaatacagagtcagataaagaagacttgaagagccaaatagaagatttaaagaaagaatcaaggcgccccggtcctcctccaccaccaaatcaagatctcaagatgtctagccacactggaggcaagattgtagacgtggatatagacgttaagatcatcggatgggatgcaatgattcgtatacaatgtaataaaaagaatcatccagccgcaaggctaatggcagcgctcatggaattagacctagacgtgcatcatgccagtgtttcagttgtcaacgatttgatgatccaacaagccacagtgaaaatgggtagcagacattacactgaagagcagcttagggtagcgttgacatcgaaaattgctgaaacacactaaaccccttagaaaatagatagaaatcgtcgagggccatgtttaaattaaaatctctggtttctgctagctctaagtaatgtttttgtaatgaagtttgagatattaagacgaagactatcttcgtgttattttttcaacttgtacctcggtggttgttgaaaatattcttgtacataaatgttaagcccgattaactcaacttaatcgggctttagttcatgtaattaaagataaatttgcctccgattatgtaaggttacataaatgaagaagaaatttgatggcgggttaatttgattttgaagtaattgcgtgttctttctttctttatacccaattttgagttgcattacaatttgattcttcaagtattttaaacaaatggctcaagagaaaaatgtgaaaagagatcatttgacaagcactatgcattattttttcaattcaaacttcatgttcaaattaaattttaaaatatacgtacgagatgtcattgcttacgaccttcatttcattaaattttgactcagaaaaataaaggattatttcatgagaatatttggatttcgttatatatacaaacaaatataccttagaaaaactgtaatctttcttatttgagtttgtttaacaaattaaacccgaaaaaaaccaacaataaaataggaaaaaagaatttcttaaaagaatgataagattagatgaaattagtcttgtagaccaagttagagtagatgcatcatcaaaaaataataaaggaaactagatggaattaatcatatttattcgtttggctgcatgcttgtttatatttatatcaaaatgatgaatatgaattgtatatatccacatatttagacaaattaaaaaaaataaaaaatcataagaagtcatgtgttgcattttttcatatggagaatacattgaacttggttctttttttggtctaaaccctatagtttattacagactaaaactaaaattatttccataatagtattaccatatcatgctttaggtcgtaactgatagcaacttttcaaatacacttcatttgaacacattcattctaacttctactccaaccaattaggccgttctctttttcgtaagaacgtaaataagatttttatttcataaaaaataataatatacacaatatttttttacaaaaaaggaggtacgagcttcaccaatgttctcgatgctagaagtcaatgtattaattcgattaaattcaataatttttactattttattagtatgaacccgacaccctaacggtagatccggcttagcttc

SEQ ID NO: 327 - DNA, 3977 bp, Solanum lycopersicum; identical to SEQ ID NO: 256

SEQ ID NO: 328 - DNA, 3581 bp, Solanum lycopersicum
ttcacatttttcatgtgctcttttcattatttacatcgagattttaaattttttaaaaaaattagaataaagttgaaaaaagacacactgccacaaatcaatcatgcataatctctttttagaaaaatatattatttttttactttttttttatatataaactagattaaatgacatatttctttatacgatattaatttgactaataataatcgtattgtgaaagaggagaagataaactaaaagaacgactctaatagaattaatattatgtaccaagtgaaactacaagcatataaaccaaataataataattataataataagaaaatatatattctatactttaactcaagcaatatgatgaatgtcacgtattatcatacaagtttattaatatgataaacaatagacatcaatttttaaaaatacaatttgtaacaaatatattatataaaataattatttattaagtcgatattatggaataagtataaatttttcacttttaattaattctcaaatttcaattctataaaaaaaaatattccaacaggaataactttcttcggttgataattaccaccaaaagaataattggaatgtagcatataatatgacaatttggacttttgctacgttttattttgtggtcctataatatgtactaacgaattatttggaagttggcttgcagttgaattacgcaactatatattctctatatacaatataacattatgtttagtactaattaggatgttaaaattaatataatatttaaatttttttgagtaatgataaacatataagtaataagaaaatttatttatttgatataatagatttgatttgaattgacatactaaaaagtaggcactttatgatttgattaatataaatggtaattaattaaatttaatttcgttgaccacctaccccttttaacaactattatttttttcttaaaataaataataaaaaaaaataacacatttttcactctatatattatggttaatattatttgaggttactccgtctcaaagggaacagagaaattcatatatttttcggtattccttcttctctttgaatggccggccaaacagtcattgtttccggtttgaatccggcggccattcttcagtccacaatcggtggagctccggtggcagcggcggcggagaacggccatacgagaaaagttgttcctctgtcaaaagatgcccttcaggatttcatggtttcaatcataacacagaaattacaggacgataaacaacccttttatgttctagatttgggtgaagttgtttcccttatggaacaatggaactctgctttaccaaatatccgtccgttttatgctgttaaatgtaaccctgaaccttcatttctctccatgttgtctgctatgggttccaattttgattgtgctagccgtgctgaaattgagtatgttttgtctcatggtatctcgccggaccggattgttttcgctaacccttgtaagccggaatccgatattatcttcgccgagaaaattggggttaatctcactacttacgattccgaggatgaagtttacaagatccgtaaacatcacccaaaatgcgagcttttgcttcgaatcaaacccatgaccgacggcaacgcgagatgcccaatgggtccaaaatacggcgcattaccggaggaaatcgagccgctcctccgtacagctcaagccgctagactcaccgtctccggcgtgtccttccatatcggcagcggagacgccgattccaacgcttatctaggagccatagccgcagcgaaacaggttttcgaaacagcagctcaactcggaatgccaaaaatgacggtactcgacatcggcggcggatttacctccggccaccaattcaccaccgctgctcccgccgttaaatcagctctggaaacccacttccacgacttccctgagctaaccatcatcgctgaaccaggtcgtttcttcgccgaaacagcgttcactttagcaacaaccatcatcggcaaaagagtcagaggtgaattaaaagaatactggatcaacgatgggttatacggatcgatgaactgtgtactttacgaccatgcgacggtgacggcgacgccattagcgtgcatgtcgaatcgtaataacctcaactgcggcgggtcgaaaacgtttccgtcgactgtattcgggcccacctgtgatgcacttgataccgtgttaagggattaccagttaccggagctacaggttaatgactggctgatttttcctaatatgggtgcttatacaaaagctgctggatcaaatttcaatggatttaacacatccgccattgttactcaccttgcttatgcttatccaaactaatgattaattaggctttaattagcatggtcattgtaattttttttcttctaattttgttcttgtttggtaatttattttccaatcagcttgtagtttcttttttctttttggtctcataagataagcaaggattagtcaattggatttgcatgtacttatattttatgtctaaataatccaatttcatgtattgaattttgtgttcgaattaatgtttgtaggaagaaaattatattgagatcgtcaccatttgaataagtcctataataagagaaagtgatccaaatttagttggtactctagaaaccggatgaaaaataaacctaaacaaattaaatttatgatataaattcaagttatgtttaattcacttaactacctcaagtttaaatatgaaatccttgcttgaaatttctcaaattaaactcataaaattcaaaaaatgaatcgaaaaaataagactatttatatttgataagcatttccccccacgttatagaccatgcaccaccgcaatcaattgcacgggtgggccatgtgatttgaattgcccgttacacatcaatcagaatatgataaaagtatatttgagtcgatataacaaatatagaaaagcaaaactattcgtatatatcaattatgatttacaaattatgaaagatatgtcatatattctctcatgaaagaatcttgagactcaataaaagagcaagttgaactcgaggtacattgattcttccaaactctttaatagaatcgaaattgtggcatataaattagtcttaccacttactctatccacaattcatcatgttttgaaaatatattttgagattcgagctatattattcaacataatgtataaattgaacaaatacttgtaatattcactatattcatttcaatttttttttatgattatatcttatgtaatcataaaaccatgttcgttaatgataaattttaaaaggtagaaattaaaagattatgaagtggaagtaaaaattaaattagagccaaattatatttatattgagctaataatgctgggagacaaagaaggtgattccctcctaaattattggaagaaaccacctacctaaatgacgacaaatccaataaataaagtgaaaccctactttaaatttatatattctcataatattgtcatttctaaaacaaccactag

SEQ ID NO: 329 - DNA, 2820 bp, Solanum lycopersicum
ttgatttgttaagatgtgtgcacaaactaaaaacaacacttattttgaaatagaaaaataaataattttcttgaataagagtatatttttatttttattttgaaatgagtgattttcttatgtaaattcaaaaaatattatttaatctgaaacggaaagattaataatgtgctcaaatattttagtgaataattgagcttggattgcgcattgagatgctcaattataatttctaactcgcacgaatgtttataaatttaatttatgtttcatttgatttgaaaacgaactttgataacaacaccagaatattgtacgattataattagtaagcttaatttttatttatgagttgtcacaacatataaagtgtactgaccctcactctcttttcttggcattattatccagaaaagttgaaacattaattcagactaatttgatccattttcttttatatttaattaaaatccatttaaaccttttgcgctttaaaaaacaatactcatttacctcttgaataggacagtaaattaaacctttttttttctaagaaattttttatttagtgattgacgaataaaattaaaaagacgtatgaatatatatttgactgatctcgtgaagataagtttgattaaaattgttatagcggtaaaattctgacattgttggaaactatactagtgatctctttatctagatttggacaaaatttcgtcgtagtacaagttagtatcgtttggattaacttattttaggtgtttttaagttaaaattgcttttgagcagttttgaagtgttgaataaagttaaaaaatgttataaacacttgttttaaagctaaaacaacaaaaataagctaaagtaaatcgaaagaggcgtgaaatttcaactattaccagatttcttggaaatgatgatttaggtacgttttttacactacaacatttcttgaaattgatgtttttcacccgttaaattaggacattgtaccatttaccaagagaaacgattcattcattttcttcaaattaactttactcttaagtataatgtatcaaacggtaggatataatccaggtccaatgaaacaaccttatgttcctcctcactatgtatctgcccccggcaccaccacggcgcggtggtcgactggtctttgtcattgttttgatgaccctgctaactgtttagttactagtgtttgcccttgtatcacctttggacagatttctgaaatactaaacaaaggaacaacttgtaagtatatacactttttttttggggggggggataaattcaatttatttgatatttggttaccaagaatatgatgtttgtgttgttttcttgatgttagcatgtgggagtagaggtgcattatattgtttgctgggattgacaggattgcctagcctatattcctgcttctacaggtctaaaatgagggggcaatatgatctggaagaggcaccttgtgttgattgtcttgtacatgtattctgtgaaccttgtgctctttgccaagaatacagagagcttaagaaccgtggctttgatatgggaataggtaatatttataagtttatacaccgataaaagtatttacgcaatcagatcactaagatttatggacattgtgttgtagggtggcaagctaatatggatagacaaagccgaggagttaccatgcccccttatcatgcaggcatgaccaggtgaaatgtatgctttttgtggtggttactaaattggattagtttcctgcagctaaattaatttctaatgccaactcatttttttcttgtaataagatgatttaactttgacaatgctatctccgactccctgcatgttcatgttaactttgatttaaatttatgcaagatcaatgaaatcatcaaacatgaatacatgagcaacacacacacacatatatatataatatattcacattaattattagcttctaggaccacaaaaacagaaaagagatacagagaacaaacaaacttaagaactagaacaaaggaaagatacatagcagtactgtactgtttttatacttatcagcattaccaagaaggaaaaagatagactaattaactttctagcacagtaatgacttaattgatatagtttgattctccacatcaacaccaatcaactctttggctctctgggcttgtatcatccaatcagttctactcaacacacaaaccatgagacatgcacaaacaccttgagcagccaagaggccaaagcaaaggcccaacacccccatcttcataacaaagcccaatacaatagctagaggcaacccaacaccatagaaagatccaaagtttatatgaacagccaaagctggccttgcactgcccctcaaagcaccacaaccggtggtctgtgggcagttgcccaattcacacaaccccaccaccggcattgctgctgctgtcagccaacaaatcgactcgtcgtctgtaaaagcattgccccaagcatttcttaatgatgtcatagatatcattagtaataagcttgtaactgtagcacacataattgctacataacatgaagtcttggctttattaggcctattagctcccaactcatttccaactcttgttgaaacagctaaacttaatgctgatggaaatatataagcaagtgaagttgcctgcaagagaattcccatagtagacacagcctctgcagcattaaaaagaacccctgataacaaaatcatcaactcataccaccaccactccaagcatacagaaatacagctagggatggcaagaatcaaaattggtt

SEQ ID NO: 330 - DNA, 3673 bp, Solanum lycopersicum
atataaatttaaatgatagaaatttgtgtggttataaattattttattattagtaaagatattttaattttaattcttatttaatatagaaatatattatatttttattagttatgtataaaaataaatcatataaattgagataaaaagaatgacttatgagttgtattggcctgacgcgtaataatagtgttgcaactgttggacttcatcaaattttatctattactagcgctaaagttaaatgtataattagcgtttgatcataaattttaaaatgaatcattttaaaataattatatatttataaaattttatcttatttaaaaatagaataaacaaattattttttagaatttacccacaaaactttaaaatttatgggtaaaccgaaaggtaatgtcctggtgaaatgaatgagaagtatgtagaaagtcggaagttggagataaatatgggaaaacatgggaatccaacagagtacgatttttttccctgaatagtgcatacattcactttattaaattctatcgcctgctagacgccaactaatttcagacctttgattgaatttttttctatagagttaataaatgacactgcagcttcctgttgctcactgactagctacaactttagccccaatcaacattctaattcaatctaacatctttaacactagtgctaatttgaagtttgtcgcattgtcttctcctccctgcgacacattatcttcttctttcttaatttatatgaacgatgaaatttaacttgtttttatattgtttaacataaaaatgttaaaatttgaataatttgtcttaattagcgtgaaaggagaaattaaaccgttatgattaaaactaattacattaactttgagtaataaatccacattaagagacgctgggtcacgctctcttcaccccctgaccccaatataaataattctcacttcacactttttgtaagaggaaaaaaaaaagcagagacaaaaagaatgggaaaaagtttgaagcttcggttctccagagttattgcttctttcaattcgtgccgttcgaaaaacccttcttctcttccccaaaatcctaatttcttcccacataagctcactagtacaaaacacatttcccccgatttccctcttattgatcaaaatcaaaatcaaaatcaccgtaattacgtgccagaatccacgatgatctccgttgggtgttgtagatcagaattcaagtgggagaaagaagagaagtttcacgtggtttctagttccttcgtgtctgaagaagaagaatgtgaagaggagatcaatttggccttacgacctcctcttacacctccgcgattcagtagaattgttgttgagaagaagaagaagaaacaacagcgagttaaaaaaacgaaaacaaaaagtagaatcatccgaatgagtacttcctcagctgatgagtacagcgggatattaagcggtactaatactgattgggataataatgaagaggaaactgaatctttagtttcatcttccagaagctgttacgatttctcaagcgatgactcatctactgatttcaaccctcacttagaaaccatatgtgagaccactacaatgaggcgtcgtcacaagagaaatgccaacaccaagaggagatcaatcaagcaatccagaccaagtttttcctcttcaaaaggtaaaagtactatttgtgcgatcaaatcttttatatttacagataattttacagtcacattaataagtattgcttttcgcgtgtggaatttggagaggacagagtaaacatagatcttatagctattttgtggagagattaatttcaaaagacacccaataacaataacatattcaataaaattccactaactagagtagaaaaaggatagagtttacacggagcttaccgttcaaaaattctggctcaaagcaaatgcatatcttatttagagatcaataattttattttaaatatttttatcgtctttttctttgggaaatagtgtatatgtaattgtcgtacaaaaatatatgaagcttaatcaaaattcattacattaattaaaacggaaaactatttaatttataattatgtctcaacatgcatgcttcctttgttacttgtttattattgggtcgaatatatgaaaatatattttggaaagacttttgttgcgctagtatttaaaaaactagtactgattaattatattatgtttgaacaggtagaagatcgtcggtttctacgtcatcagatagcgagctaccggcaaggttatcggtgtttaagaagctgataccgtgtagtgtggatgggaaagtgaaggagagtttcgcgatagtgaagaaatctcaggacccgtactaagatttcaagagatcgatgatggaaatgattttagagaaggaaatgtttgagaagaatgagctggaacagcttttacaatgttttctgtcgttgaacggaaagcattatcatggagtgatagttgaggcgttctcagacatttgggagactttgtttttaggtaataatgatagagtaaggaggatgtcaattcatgatcccacacccacctactgtaggtagtagtagaagaacctcctttgattaatcatgatttagttgttaattaataaatttaacttttcttttatgtgttaattgtgatttaattggagtacgatatttcactgttttttgatagtgctacttatcatcatttggctttctaaattctgaaaataccgtaacgattagcacctgaacttgttttttcaacttaaaattgatagtgcagacaactagcaagaaaattcaaaatattaagaaataacagacaaaataaagtttgattcaacgtctagaatatatacataaaaaatatctttcactttaacataaaagagagtttaatgttttacttgctcatgggacttctaactccaccctggataaataaaaggacaatgtaaaaatcagtataataatagcaagttaataataacaaattttttacattaataattgtcaatcatgaatgcttttgtttgcttttttgaccaaggggtatgtatacctcttagcaatgagaaaagaacaagcctacaacacgcctatatctatggaatgatattataccatttggtttaaactttttaatttcttcaaaattttgatacattttaatctacttaaactttaacatcacatattttaaataagtatttttatttttaaaacttcatatcaaatcaaaacaaacgagatcatgttaatgaacagtatcgaactttaatatgtagtgagaattggagactgattcgctggttctgactggtcaggattgatggatggaacatagatgtaacccaacaaagaaactgcaaattataaattcacaacgtcttccccaaaatatgtataaatttccatcaactttaatagattctttcatgtttaacaattttccaggattccctcaatccttgcatctaccatatagaaacaacaagtctatgctaatatatatctatatctatatatataaataacctaactatgcagtgtaattttatgataaaaaaatatcaaattaaaaaaatactttatacgtgactccgccactatctgcgactcgttatcataatttttta

SEQ ID NO: 331 - DNA, 8876 bp, Solanum lycopersicum
  modified_base (4439)..(5792): a, c, t, g, unknown or other
  modified_base (8115)..(8876): a, c, t, g, unknown or other
agacgaaattgttcgagtccgaatcgaagcaccaatctaatttaggttgagccgcatatttaggaggacactttcaatagtatttttttcaagcatgaatttgaaatttaagattaatggtaaagaagtagtacatcccgaattaattcatgccttttttaaatataattatataaatatttatgatttgttttaaatattaaaacttgaatatattatttttaaaaaaattatctattaagtaccatcacataattgagacgaaggaataattaagatgaacatagtgtttaattagtaatggatgggtagtaaatttatttataaattatatcaataagttaaattataacaaatatttgagcgccatgtattttaaaaaatattaaatagtttgaatttaaaaccgttagataaatggtcaattttgaacccaaaagtggatgagaagggtattttagagccaatagggggatgagaaggatattttgaagccaatatgtgatggatggaggataattttgtatcatttctaatactttaaagatattttaggtcattttcccttctttagtttatagactatagtgttagttcatcgaatatcatctattatttccgtcttaaattattttttattttataaatttttaaaaaataaattattttttccatttaactttgattgtaattaatttttaaaaattaccaacatataaataaaattaatatttaacaaagaattgtaacataatatttttttaattattcaaaataaatatttttaaacatcatataaaagaaatacgacaaaaaaattgagacgggagaagacaagccagacaaaaatgtccaagaaactctttcgtctaaatatctctcatccaaactaatataatacccattacaattaaccatattgaccaactcaaaccccttaaaatctataaatagacaaacccttcccatacctcttatcataaaaaaaataataatctttttcaatagacaagtttaaaaaccataccatataacaatatatcatggttatccaaaggaatagtattctccttctcattattatttttgcttcatcaatttcaacttgtagaagcaatgttattgatgacaatttattcaaacaagtttatgataatattcttgaacaagaatttgctcatgattttcaagcttatctttcttatttgagcaaaaatattgaaagcaacaataatattgacaaggttgataaaaatgggattaaagtgattaatgtacttagctttggagctaagggtgatggaaaaacatatgataatattgtaagtatttaaatattggaatatatttgtggggatgaaaatgatagagaatataagaattatttggaaggatgaaaagttatattttataaagtagaaaattattttctcgtttttagtaattaaaggtgaaaaatgagttttctcgtaagcgaggaaagtcattttccatggaactgtatttttttttacttttaataacgtcatagtatttgctatactcaagaataagacactattattgatgtttagtgctcgaaaagaaattgatagtaattttgctaatataactatcaatttcttatatgtatatttttcaaccaaaataacaaagcgtaatccaataagtgggcctctagaataaagagtaagttctattaattcttaaccttatttaattttatggaaacctcgacaaaacgacaatgctcaacttatattcgaattcgagaccaaccatatgaacaacctcacacatgcatatagtcctaatatatataatttttctaaaaaatatcttcaatctaccatattgaaatattgaaaaatgacttttatcctatcgaacacataatcaagagtttcttttaagaatttaccactacatttggtagtgtttcttatcgtgttaaaattatctttcaggcatttgagcaagcatggaatgaagcatgttcatctagaacacctgttcaatttgtggttcctaaaaacaagaattatcttctcaagcaaatcaccttttcaggtccatgcagatcttctatttcagtaaaggttagcatattgattatttatatcctctttgttagcaatatattatctggtttatgacaaaatttaagaaagtaatcaaagatagctaaacaatgaattttcgtcactaatttagcggattagtgaggaattatcaaaatgttatgttagctatgagcaacttagctatgaattagctagtgaagaagtttgatgctaattctatttttttttgtagagtaaagatatttgaaacacatgtattaattattaattatgtcttaattaatatgtcaagtggatagttcaaactaaagaactgtcaaaagaaaataagaaagaaatatttatttttaaaataaattaaaaagaaaaatatgagaaataaattcaaagcgagaaggtattacataatcataggggataaaaaggatattatatagtaaagaaaaacaacaactacaacatatctaataaagtctcataaatggatataaaaaaagtattgtgtaagcaaacattatccctacaaaaacttttgtggggtagatcgatccagaggttgtttccagactcttggcttaaaaaaaatgttttttttctaaataagtttgaaagaaatgttatatgatgaaaatatgaaagaaaaaacatatcaatattaaaaaataataaaagtaatcaaagtaaacgaaataacaataggaataatactcataaatgaaaatttagtggctttcgtactacataatcttagtttattcattgtttctttaatttcccttcttattttttttgaaattactatgcagatttttggatccttagaagcatctagtaaaatttcagactacaaagatagaaggctttggattgcttttgatagtgttcaaaatttagttgttggaggaggaggaactatcaatggcaatggacaagtatggtggccaagttcttgcaaaataaataaatcactggtaattttataaccttgcttataagttttacgctatgttgctcgaattctttaaacttgttctaaagatattatatatttgaaggaggtgtcacaaatgcatcacatttttagagattccgaccaatattagttttatgtaatctaattttcagagcatctttgccttgtactgatcattgttaccctttttttcttcatgcagccatgcagggatgcaccaacggtacgttaattcatttgatttgataaaaaaaaaagcctaaaatatatttgaattttaattgaaattgttataataattcttaactttgggcaggacctattacccctttgcactatttaatagtgtattttaaagatataaaagtgtttagttgaaacaaaaatttagatattcaaaaactatatgaaaattactataaattgcaatttttttgcatatcaatatgattaaaaaatattagttaaagttcttatgatttgattctaaaaataaaaatcatgacaaacaatagtagacggagaaagtatataacaatacctcttcaagtagaatcgatttgtacacacacctcaaaacctacgtttcttcgattatattttcctatttcttttaatagttttaatcaaagctattagttctgtcaaatctatacattgaaactctatctttgacgcctctgacattcgagatcgttgatttacaatggatgaatgattatttaactttctatttaaatattaaaactaatattgtttaattttcaggccttaaccttctggaattgcaaaaatttgaaagtgaataatctaaagagtaaaaatgcacaacaaattcatatcaaatttgagtcatgcactaatgttgtagcttcaaatttgatgatcaatgcttcagcaaagagcccaaatactgatggagtccatgtatcaaatactcaatatattcaaatatctgatactattattggaacaggtttatttatttaatttttatttatccaatttaattagaaaaaaaaaggagtatttttatttgataactaaattattaattttaattttttttataggtgatgattgtatttcaattgtttctggatctcaaaatgtgcaggccacaaatattacttgtggtccaggtcatggtataaggtactctattttacaaatatacttgtttccattttctctatttcataaaaggtagtatgatataataattactttaaatcctttaattaatttattggcaaattttttctcttgtctttatggttaatgacttagcacaataattagggcccgtttggatgggcgtaataaaagcagctttaaaaaagtacttttaaaagtgttgaaacttatttttaaaataagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaggctcttaaaatgtctgcttagatgtgctatatatatttgagctttttttgaagtagtatattatccttaagttcaacataaaaatacatgctttaacatagcacatatagttaatcaaaagacgaaatgatgaataattttgcgaatttgattattcacaagaaaagggatagttcaaagtgtacatttcaagtaattgaagatatcataaagactaaaattagaagaactaataattgagggatcaaaaatgttattaccttattaaaatactattccattttcatattaaattaactaattaagagtgttttataatctaataaaacatgcaataattattgacgaaatgtggttttggtacctataatctttctgaatatttgctcttattttttctctttttatttttccatggattagtattggaagcttaggatctggaaattcagaagcttatgtgtctaatgttactgtaaatgaagccaaaattatcggtgccgaaaatggagttaggatcaagacttggcaggtaccctccccccccccccccacacgcacatttttttaattttttttaaatttataatcgaatatcaatattaaaatatgattaaatttgatttcatgtttgaaaatttatatttggaataaaagtatgtattttactagctttctatgttatatagaaaaaaatgttcagaacttcagattattgtactcgtactaagtgtaaatgtgttgctttgtttagaagtttggtttatccagttttgggtcatgattaaaccaaacttataatgaaaaggggctgcaacggccggtcccactagtgctagtatcaataggaagatctcacgtctgtttattcagatggacgttcttggttgaatgttaataattataaatttaattaacatgtaattaagcattatataaattaatataatgtggtttaataatgtagggaggatctggacaagctagcaacatcaaatttctgaatgtggaaatgcaagacgttaagtatcccataattatagaccaaaactattgtgatcgagttgaaccatgtatacaacaggtaattttttattaacgaacaatttattatattttattacttcttaaatcaccttacatcattaaaactttgagattcttttcactagttagtaactttttgaatagatttttagtaaatgatattcattattccttttatttttcttctaatttatggatcttttggactatggtctaaaaatcttgttaaagtaaactgaatatcataagaaaaaatgttagattataatctaaattttttataaattattagacgttatctaatattttgtatgtaagattgagaaacatatacataaaacattagattcaaatttaataatatctaaaatattgattcaaatcaatcatgactacacaaacgaatacatgcagattctcaaacatatagatgaagtcatttcaaaacgaatcaaatatagtagagtatatccttaaaagagagcatttgggtaaataagtaaaaatcattaagttataaaaaaaattctaactcgatctctcacgattatttaatcactttgtttgttccagttttcagcagttcaagtgaaaaatgtggtgtatgagaatatcaagggcacaagtgcaacaaaggtggccataaaatttgattgcagcacaaactttccatgtgaaggaattataatggagaatataaatttagtaggggaaagtggaaaaccatcagaggctacgtgcaaaaatgtccattttaacaatgctgaacatgttacaccacactgcacttcactagaaatttcagaggatgaagctcttttgtataattattaatttatactatagatcttcaatatatagcagatatgatatatcacaataaacaaatctatatctatgtattgaataattattattaatatgtacggattgaagttttaataagactactatgtatttctattttctagtcaaaagtttgacgattgtactttttaatgtacaaaaataataaaatggttatttatatgatgtatatatatccctttggtatttcttgttgaactataatgtcattatttaataactattatctgtgcaatgattgtatttgttaataatacataatatatctttcatcattgataataagaataaaatattttacgtctattactttgtgattatatgtagatttttgtttttgttttatttttaattaaaacgagtgaaaatactaaaagagttatttaaaattctacattgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 332 - DNA, 6668 bp, Solanum lycopersicum
gtaaataaccactttcaaaaagtcataaaacaaaaataagtttctcccaccttttactttttaacttaaaaatcatttcagtttgattttttaattttgatttaaaagatattttttaaaattaatcctaacatgactttaataactatcaatcaaattagtaacattataattgtttattattagattcacacaaaggcaataaacaagtatttattacacttggcttgttaatcaagttgtaatacacaaggcaataactcaatatcaatttatatctaatttatagttattcattaattgtaactatacaatttctccaaactatcactaaacattatatattgtaaccttccctttaattttaaaaaaataacaatttctttatttttattaatttaactaggtgttaaatttcaaattattttattatatatttgaaaagacaaaaaactacctaacaacttttcttcattggaaatccacccctagatttagaaatacattaacaacatttcgacacactcgagggtacctttctaaagcacatagatttggaatatacaattagctcacttaattataattaaaaagaaaataaacaacattttagtccctcatttcactttattagtttcttttagttattattatgcgtattcctaatatttaagagtcatttatggttctaccattcaatgactaataagtcatgtcttacgtagtgttctatttatattacgtaacgcaagacgtttacatttttttggttcaaatttataaaaggttaataatctatttatatatccgttgaagaatataattatcgattgaagtcaagttaaaaagacgtatattttgtgtcagactaactaactaaaggactaaaaatgcaatatagataatcaacatcataaaaccaaatcaacggttgtaattaacccaattttttctacatatacgtgctgccacttctcatccaatttgttcattgaaaaaaaaaaactataaacttttttctcttcactcttttctactatttctctgttcatagatctaatggcaactatcaaatccattaaagctcgtcagatctttgacagccgtggtaaccccacagtcgaggtttgttttcattcagatctctcttttttcagattttttttgatgtttttttatagattcttttcgatctgtttcaagatttgaactttttgagttttttatgcttacccatttgctgattttgtttaaataatttgttgttataatgggttttgtttggatttctgaatggagtttgtttgagagtgtttggttttgttagattggttgttgatgcagattagttgtgttgtatttgtttcaagattcaaactttttgagttttttttaatgtttatgtttatcgatttgctgattttgcttagattgtatgttgctgttatgggttttgtttggacttttaaatggaggttgcagagtagttgtgttgtatctatttgttgctgctataagttttgtttggatttttgtaaagatgtttttttgaataattagttggttgtgttggattggttattgatgctgataagttttgttaaatcagtttgaacacggaggtggattcaagatttgatttttatgggctcagacatgctagttgttgcaatagtagagatgtttttcctcaggtgtattgatttgtttgttgtgtatctatgcaggttgatgtacatatctcaaatggtgtgtttgccagagctgctgttccaagtggtgcatccaccggtaatgatctagctttgttcttgtatatagtgactttttcaaacactgattgattagactgtgttgaaaattgtatgtgcagatgcgtaattagttcgttatttaacttgtgtaatcgaactcagagtttcttgtttgtttgcttggaaattatagagacttcctttcaagtgtgtatttattaaacttcacccttttgatcagtttatgttcagctatagatacttgttcttcactaaaaagaatacatttttagtaacagcatgtcactattctaaaacaaaaatactccctctggttttaatttgtttgtatggttttgactgaccatggagtttggagagttttgaaccttgtggtcttaaactaatgatttgtagaatgtaccaaaatctcgtttaatcttgtggtcttaaacacggtgttgaaagttgaaattaaagagttagcaaaaaaggaagagatattttttttaaacgtactaaaaaaagaaagcgagacaaacaaacaaattgaaatgcttgtagctcatctgatccacggattttgcatatatcagtttgggtggaaatgtgaatctttgctactttctgttattttgaacgctgttaacgttcttggcaaatgtgtccttttgttattaccctttgagttgaaaggtaatgcgttatctttacttgttcaataataggaatttacgaagcccttgaattgagggatggaggatctgactacctcggaaagggtgtttcgaaggttggcgtttcactgctaagctttagtttgatgattatactgatcattttgattaatattttttaatgctgttcttcccgtgtaggctgttaacaatgtcaactcaattattggccctgctcttgttggcaaggtttgttgtatttctcccgttaatatcttaataggctatttttttgttaagttgctattattgttcatttctgacatacaaagtattactattttccaggacccaactgatcagactggtcttgataacttcatggttcatcagttagatggaactcaaaatgagtggggttggtgcaaagaaaaggtgttactatttatgccaagtataaagttaattattctatcaagagaagttcatctttcatgaatataactgtattggcttttcttcagcttggtgcaaatgccatccttgctgtgtcacttgctgtgtgtaaagctggcgctgctgtcaggaatgtgccattgtacaaggtatacagagaatcacttcttgttcgagtgtctgacttcccgagtagttgtcttttgtatattaggcagaaaatgtttacgttaatattttgtgcttgtgaagaatgatgtctcacttttactttagttatttcgtaggatgatttatcttgattgtttaaacagtagtcaagagagggattcattggttttcatggagtccatgcacattctttggatttatctacaccctaaggcctaagccttgcatcgctattgaactattgccaattggcaaggcagaaaccatatgaacctttaatcttccccatgtttactgttcctatatgtgactcacgttcctcccaccccaatgcaaaaaataaaataggagataaaataaattccaccatttgattctctattacctaaaggctactaggacaaattaagtttctagttgcaattggattaatctgcgatcatgtggttacttgtatatattgcctcctctctttgcagcacattgctgatttggctggtaacaagaagttggtattaccagttcctgccttcaatgtgattaatggtggatctcatgccggaaacaaactcgcaatgcaggtatgccattagtttgcgtcaactatgcatccgtgtgctctttactagaacgattctcattagtagttatcttgcaggaatttatgatccttcctgttggagctgctaatttcaaggaggccatgaagatgggctgtgaagtctatcaccatttgaaggtttgagagcttttattacctctaaatattgttttaggtggaccaatcttatatatgcttttgaatttaggggatcgattggtgtctttggctccattcaagctcacaatctcatttgactttgttcatgttatactttctcctctttatcttgttttgtctgataatagttatgctttaattgcaggctgtgattaagaagaaatatggtcaggatgccacaaatgtcggtgatgagggtggttttgctcctaatatccaggtgaagtacattcttatgctgttgtattacatcctgttgaatgttaccccagtgcactgacatgaatatggtttcgaaaattcaggagaacaaggaaggtcttgaattgctcaagacagccattgagaaagcaggttacactggaaaggtgagtatctcaattacattttgagtcgcacaattctttgttttcatagctgttgttagatgatctggtggctgagatgattttctttttaggtggtcattggaatggatgttgcagcatctgaattttacggaaaggacaaatcttatgacctgaacttcaaagaagaggcaagtactaactattgcttctttcacacatgcttttttcgaggtagtcttgtagtcaaactgttcatacgttgttcagttttgctcatatcaattcttctttgcagagcaatgacggctcacaaaagatatcaggtgaccaactcaaggacttatacaagtcatttgtgtccgagtaccctattgtttcaattgaagatccatttgaccaagatgactgggagacctatgctaagctcactgctgagattggggagcaagtacagattgtcggtgatgaccttcttgtcaccaaccctaaggtaaggttgaagcttgaactatattaagtggttgcatatcacagtttttgttgccattgaaaagaaaagacagaccgtcaatcaatttctctaggtgttattgtttaccatgtttacttatttataatggcttgcagagggtcgccaaggcaattgcagagaagacttgcaatgctcttcttctcaaggtataggtcatatatatccccgtcatgataatcaaagtttcctctttgagattgtattaaaacatttctctctcgctgtgtgtcaggttaaccaaatcggtagtgtgaccgagagtattgaagctgtgaagatgtccaagaaggcaggttggggtgtaatgaccagtcaccgcaggtaaagaaccaacgatcctcatcctccacgatatcacttcacagaaagtataataaatttcgagtagtcatgttctaattatctcataaaactaattgttgcagtggagaaacagaagataccttcattgctgatcttgctgtcggtttgtcaacggtaagctttatagaatccagattatgatactcaacagattgtaggtgttaacttaacgagtattctcccgaatataatcagggacaaatcaagactggagctccttgcaggtcagagcgtctcgccaagtacaaccaggtaatttatcgttcaaaaatccagccgttgaactctttcaagtacacttgcattcccagcaagcttttctgatatttcgttcatcctatttagctgttgaggatcgaagaggaactcggatcagaggctgtttatgcaggagcaagcttccgcaagcccgttgagccctactaaatttcagcagttccaagtgttgagattgttgagttgttgatctgccaaaaataaattcctcttagattggtcattttaggattatattatatgaccttggtgaaataacaagcagactcaaaaacaagttttgttttctgaggttttattagtattttgaattctgaaaagaaaaaaaaagagttttttttaggcttggttactgtaaaactttgatatgcaagtttctactatgttctaattaatattttgatggttttggttttttcaaatctcaatctttactttgctatataacataagatgtgctctttttggagaaaactattatttattagaaaggacttgaataaaaataactatagttaatattacaatggaaaaagggcttaaaacactttaaagtattgaaaatggtacaaaattatcttactcccttgtcatactcctatccgctctcaaatatctctttgcgtccaatattggtcacttttataacagattatcatttaaatacacgcttcgatccaaataaattaatttcacccgtcccaagtaacaattttctaacatttcacttaatcttgcagctttcttctccaatatattcgcttacgatctctaaaaacactacctaagtacgcacatgtattatcataaaaaatcatgcatgttttggtaaatttcttatggtatatttaggtagtaattttttgttggggaagtaaagttggaagaggaagtaaaatattgggaatgaagggtgcatttgttttaatcgatgggggtaaatgtaattttgggagggtgtggttaatttgagttgggtatagttaactcctataaaagtggtcagtattgaattcaaatatggataaaaagatactgagagccaataggtggatgaaggataatttcgtatcaattcaaataatttaagaatattttagatccttttccgataatacaattaactaaagtagaggaaataatgtaaaacttctatacaattttgtgagctatcaaccacaaagaatagtagaaccaactataaatgatatacataaaagtttattagaaagtaaaataaaaaccaaacgtacaactagcatcaaatctctttctatctatctgaaaagaatatatcactcgatcgct

SEQ ID NO: 333 - DNA, 8421 bp, Solanum lycopersicum
  modified_base (128)..(740): a, c, t, g, unknown or other
ataactagggttgtgggaaccataggcaaataatgagataaaccctaactaaaataacaattctagaatagtgtcttgcatgtattaataattctttctattagaagtccttttaacgaatggccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaataaaaaatgaaatatttctcatatacaactttttgacggcaaaggtttggggagtgtgtaaaaagttcttaaaaattaaatttaaaatatttttcaaaagcaatttcttttgatgcgggttaagggttagataacgtaaaaatatcttatatgataaacttttatttgaaaagtacattattttctttaaattaaaaaaataaattaattaaaaacatttttaaaaacatttaagcaacaaaagactttcaaagtgtaattgttgggcaagaaaaggggaaaagagtagtcaaagaaggttgtagaacaaagaaaagatgagttcaatttcgttagaatgttttgatgattttacatagagaagtttattcaaagtatgttaggtaaatgttggagagtgaaacaccaaaaactgttgtgattattatatgaatgaaaatgtagatccatattttgcagtatcagctcttaattctctcatattctgacacccttttctcccttgaaaagataagaggatgatgtcttcacgtgatgtccataacttcctgttaacttgttattcgaggtatggcctctctctttaaaatcttgttaaacgattgacatcacagtccttctacaactattattattatatttatatttacacccactcaagaattattatatattatctctacttggggtttgattttttttttaattcaaaaaattttatctttttttatacagagctgcacgacaaatgaagattgaaggttatgctaattttgggatgacaccaaataactatgtttggaaaggaaacaatggagcaactcacttgtttctagtaaactctctctcactctctatttattgagatttgtaaacatactgtgtatatgagctttgacctgtgtgtttttaatgctatcgataaatctttaagagaaatccaagttgtggtccattttttgggaatttcagacctaccagtttattatttgcttcagattcagatcaactataacaacaattcacctgaaacctattattttgttgttgtctctcaaagcttgtgaaaggtaatttctttcactgattatttttcttctgcaaattcaacttttaaggatatactatataggttgtgattaggttgttaatccagctaaaacaaactactagcttactgtgtactatgcatatgtgtctgcatcatctagtttcttttgttatatagttagttatctagtgctaatttgtggatccggaattacctgacttactcagttaaactctttttagattttcttttaaacatatcatccctcctggtgaagtggggtgagattgggagtggatggaaaatgttaagctgcaaatagtgatttgatgtttcatattgatgaaaggtagaggctttacgataaatcatccatgtgtttgttctagttcaactattgttgatataaaaaagttaaaacttctgttattatgactttgagagtggcggatgtttacagttcctatttcaactttgtagcttcaatgtataatattaatcctgtagtagttattttgtatgttctatttagatttgagtcgagatgtcgtcttcaagacctagccaatcttccaccacttcatcaagatcaaagcacagtgctaggatcgttgcacagacctctatagatgcaaagctgcatgcagactttgaggagtcaggtgattcctttgactattcaagctcagtgagggttacaagtgtcgctggagatgaggaaaaaccaaagtcagacaaagttaccaccgcctaccttcatcagatccaaaagggcaagtttatccagccatttggttgtctgttagccctggatgagaaaacattaaaggtcatagcattcagtgagaatgcccctgaaatgctgaccatggttagccatgctgttccaagtgttggtgagcatccagttcttggcatcgggactgatatcagaacgatcttcactggtcctagtggcgcagcattgcagaaagccttggggtttggggaggtttctctgttaaatcctgtccttgttcactgtaaaaattctggaaagccattttatgcaattgttcatagggttacaggtagcttaatccttgattttgagcctgtgaagccctatgaagtacccatgactgctgcaggggccctgcagtcatataaactagcagccaaagccattactcgcttgcagtccttgcccagtggcagtatggaaagactctgtgacacaatggttcaggaggtttttgaactcacaggttatgacagggtgatgggatataagtttcacgaggatgatcatggagaggtggtgtctgagatcacaaagcctggcctcgagccttaccttggtttacattatcctgctacagatattccacaggctgcacggtttttgtttatgaagaataaggtccgaatgatttgtgattgccgagcaaagcatgtgaaggtagtccaagatgagaagcttccatttgatttaacattgtgcggctctactcttagggcccctcactactgccatttacagtatatggagaacatgaattcaattgcatcacttgtaatggcagttgtggtcaatgacggggatgaagaaggagaaagctctgattcttcacaatctcaaaaaagaaaaaggctatggggcctggttgtttgccacaacacgaccccaaggttcgttccctttccactgaggtatgcatgtgagtttcttgcacaagtctttgccatacacgtcaacaaggaactggaattggaaaatcaattccttgagaaaaatattctgcgtactcagactctcttgtgtgatatgctgatgcgagatgctcccctaggtatcgtgtcacagagccccaacattatggatcttgtcaaatgtgatggtgcggctttgctctataagaataagatacatcgattaggaatgaacccaagtgactttcagctgcaggatatagtatcatggctttgtgagtatcatacagattccacaggcttgagtacggatagcttgtatgatgctggttttcctggggctcttgctcttggtgatgcagtctgtggtatggcagctgtgagaatatctgataaggactggctgttctggttcaggtcacacactgctgctgaagttagatggggtggtgcaaagcatgaacctggtgagaaggatgatggcaggaaaatgcatcctaggtcatcattcaaagcattcctggaagttgtcaagacaaggagtataccctggaaggattatgagatggatgcaatccactctttgcagctcatactaagaaatgctttcaaggatgctgaggttgtgaattcaaataccaattccatctataagaagcttaatgatctaaagattgacggaatgcaggaactagaatcagtgactgctgaaatggtccgcttaattgaaacagctttagttcctatattagcagttgatgttgatgggcaggttaatggatggaacacaaaaatagctgaattaactggtcttcctgttgatgaagcaattgggaaacatcttctcactctcgtggaggattcatcagttgataccgtgaataagatgttggaattagcattgcagggtacgtatctttgtgcactcccccctctgtgttatgttgatgttatgactcttttcgtgaagattgattttctacactattttaatttttttgaatattattaatgatttttgtctatccattcagttaaatgaattatgtaataaaaacgattaattttccacactaattaattattttgaatgttatagttcacatgatttttgtccatccattcagttacataaattatgtaccgaagatttaactgaatacaccattcctttaaccagggaaagaggaaaaaaatgtagagtttgaaataaaaacacatgggccgtcaagagattctagtccaatcagcttaatcgtgaatgcatgtgcaagcaaagatgttcgggataatgttgtgggtgtgtgttttatggctcatgatataactggacaaaaaagcatcatggacaagttcacccgaatcgaaggtgactatagagcgattatccaaaatcctcacccattgatcccaccaatatttggcactgatcaatttggctggtgttctgagtggaacactgcaatgaccaagttaactggatggcggcgtgatgatgttatggataaaatgctgttaggggaggtttttgggacacaggcagcttgctgccgtctcaagaatcaagaagcgtttgtaaatttcggagttgtactaaacaatgctatcactggtcaagaatctgagaagattccttttggtttctttgcacgttacgggaaatatgtggagtgcttactctgtgtgagcaaaaggttagataaagagggtgcagtcacgggactcttttgtttcctgcaacttgcaagccatgagttgcaacaagctctttatgttcaacgattatcagaacaaactgcgttgaaaagattgaaagtattagcttacataaggaggcaaattaggaatcctctttctgggattatattctctcggaagatgctagaggggactagcttgggcgaagagcagaaaaatatactgcatacaagtgcacagtgtcagcgtcagctcaacaaaattcttgatgatacagatcttgatagcatcatagatgggtacgctactctcatttatcatatcttatgtgttttagtttcaataccccgagttccttcccgttcatccctttttagttaaaacttgatcaaggtatgatggttttgtagcaacaagtaaatgcttggatttgatctgtgcaagaacattttttgcagtggaagtgttgttcttggaatatatttttgtgcatttgatatgatattaagtttgctttgctggtttatggttttcttgtccaatatttattgtttttagctttatgtttatcattttaaatgattttttacactgtaatatttgctcttcttctaatctcttaccagttatttggatctggagatgctcgagtttaagctgcatgaagtattggtagcatctataagtcaagtcatgatgaagagcaacggaaagaatataatgatctcgaatgacatggttgaagatcttcttaatgaaactttatacggagatagtccgaggcttcaacaagtccttgctaactttttgttagtatctgtgaacgctacaccaagtggcggccagcttagtatttcaggcaggctaacaaaagatcgtataggagaatctgttcagcttgctctcttggaattcaggtaaatccatatgacagaaaaaatcaccttgaccagatatctactgtccaagttagcatctcccgcaaaaacataaagattgaggggtatctacacaatctattgacatctaagcatttaaaaatccatctttagggttaaaaactaaccggtatctctctcaatacctgtgattcatatgttatttctgtcctcagtaatttttgtttgatagtgtatctattctctatcaaattgggaacgtaaaagtttttcttgaactcaaatgtctcaatgtgtttgaagtccttatattgccattgcatttgatccttggcagttcaaactgctacttctttgtcttctctccatttattttgtaaacattgattgcaaaattgctagtttaattagaagataaattataattctatatttttcacaatttttagtaaaattgttctgttggcctaaacatccttcactcactattttatcagagagtcaaatatctgagtaggagttttcaaattcaaagagaagtgtaatatgctctctaactgttgtaaggttattgctaattcattctttggacaaacgaaaaatcaaccttcagcattgaggtgtaaatgttgagtttttcatctattacttgaacattaaataaccccagatagcaattagagtctagagattgatgagaccaggcttaaaaaaattattttaaattgagaacgacaaatgaaaatcatacttctctcagaaagctttgagttggcatatgtggaatggtcttgtcctctatttattcaattgtggtgattgagttttaaggctagacagatgaatttaaataatgacaagaatcagcaccatatgttacttgtacaaggctgaccaggagaaacattacttgctatttcaggataagacatacagggggtggagtgccagaagaattgcttggccaaatgtttggtagtgaagccgatgcatctgaagaagggatcagcttacttgtcagcagaaaactggtcaagctgatgaatggggaagttcagtatctaagagaggctgggcaatcaactttcattatatccgttgaactcgcagtggctaccaactcaagctgatgattttcagtaccctcttaaggtcctaaactaattctgcaggtctgtatagtggaagacgatttcaagtttaagatttcctctgttttgtgctcgttcttgtcattttccctcctctttgttacattgtttgccttggatttttaaaagtcacttgaacaattgcttcttcagcatttcaatttcattagaatcctcatctcccatgtcaaaatgctcaacattttataactgtagtaccagaattcaagatttgatatttagagaaggcaaatgggttgcttgggctgacctaacatgggttgggtcataatgggttaaacgatgagtcataggagaacccgtccaacttgatctaacctttgttctttctctttcaaggagaagaattacgtgatatagcgacttaagacaattgatagtactactttcaaattattacctaatatataataatttctgaaacatagcaatcccattgatattaagctctaattttggtaacccttatcccttccattatctactctatgcattttgaaagcaaactctcccttctcttccagtttagcactaaagtagctaataatgacatccatcaaggtatttgcaaaacatgcattgtttactagatttaacatgaccttggcaagatgagcccaatccatatttttctattcctaaatcttgttggagatttttggacgtaaatcctagctcagacaattaaaagaggtatgtatttcatttaagagacatcttaaatattgctatttagcaacaaattttaaagggacagaaaatacattacaatcacaataaaataagaaaaaatatgaatttattgataaatatgcgggtacaattttattggtctattgaatctattctttttagatttactagtttctgaggacgtgcttcgcacgtgtgttccatgtgaatttttgtagatacgtttgaatgactaaagtttaatggaaatatatatgtaaatttaatgaataataaaatgtaacaattacaaaataagaataaaaacttacgcaatataacattcatagaaaactaaataaagaagtataaaggagaaaaaaaagataaaaagaaacagatttaagaaaaaatataatgtagacatgaaaaaatcagtacataactctctgagttcttatcgactccttccatatcctatcaaaattcaag

SEQ ID NO: 334 - DNA, 6862 bp, Solanum lycopersicum
tatttattcacactccttattcattgacaattgaagattaaagtagagatatataatatttaatttaaattaagtaattgtaaatatatattgcactttttcatttatatcaatattagggataaattttttaatttttttaaattaaaaaaaaacataggaatcaaacaaataaaaactactttttgcttgctttacacctttttgccattcttcaattcaatagtcaccaaatatacctaactaactactccattaaagtgtagcatttttttttcacaatcaatatactttttttttaatctttataataataataataataataataatatataataataataatagttcttcgggatgactcaattgacttagaggatgatccaggatcaattcccgctcaatgttttctgagtctagtttgtcgcataaagcttgtcatattggacttcatgtgtgatacataaagtgctcactcgaaaatagaagttatgatttctaaatcgaacttgtcatattggacttatctagtactgttaaatcccttgtatggagccgatagtaaatcaaatcacttaaatttaatttaataattaccaaagggttttgtattgttgatgtataatagactcaataaggatctccataccctcccctattgtttaagaatttttcataatcctctatacataattttagaaaaattcaattatatatttcttcaaatctaaaatttaccttatcgagtttttatctcacgcaccgaacgagttcaaccttttttttatcttcaagataacaacaactttttttttttggtataccaattctagttgttaatctctaaacatctatttaaagtatattatttgtagttattctatttttgtatatatatttgtcttgcttctctctccttttttccttcactataaagaaaaaaaaattgttgttgttcttcaaatatgcagtaatcttgttgttgagtgattcaaaaatggcttctgggagtggaagtagaggaaaacatgatcgtaatcatcagccgaagaatcaatcgcaattttcaggtacaagtaatactaatgcattaagcaaagcagtagcacaatatactactgatgctaggctacatgctgcatttgaacaatctggagaatctggaaagaattttgattattcacaatctgttagaaatagtacagaatctgtaacagagcatcaaattactgcttatttgaataaaatgcaaagagggggtcatattcagccttttggttgtacgatagctgttgaagaggcgagtttttgtgttattgcttatagtgaaaatgcatgtgagatgcttgatataatgccgcaatcagttccaagtcttgagaagaatgaaattctcaagattggaacggatgtgaggaccctttttagttcttcgagttctggtttgcttgaaggtgcttttggggcacgagaaattacgttgttgaatccgatttgggttcattcgaagaattcggggaaacccttttatgcgatattgcataggattgatgtggggattgtgattgatttagagccagctagaacagaggaccctgcattgtctattgctggagctgtgcaatcgcagaagctagctgtgagagctatttcgcttttgcaatcgttacctggtggggatattgatcttttgtgtgatactgttgttaagagtgtcagggagcttacggggtatgatcgggtgatggtgtataagtttcatgatgatgagcatggggaggtcgtggcggagagtagaagatcggatttggagccttatattggtttgcattatccagctactgatattccacaagcatcaagattcttgtttaagcagaacagggttagaatgattgtggattgcactgccatccctgtgagggttattcaggatgaatcactcatgcagcctttatgtttagttggctcaacacttagggctcctcatggttgtcaccctcagtatatggtcaatatgggaaatgttgcgtcgttaacacttgctgttgttataaatggaaatgatgatgaagttgttggaggccgaaatgcaatgagattatggggtttggttgttgggcaccacagttcagctcggttcattcctttcccccttcgttatgcctgtgaattccttatgcaggcctttgggctccaactaaacatggaattacaattggcatcgcagttggctgaaaagcgggttttgaggacacagacagtgttatgtgacatgcttctccgagactcacccacggggattgttactcagaacccaagtattgtcgaccttgtgaaatgtgatggggctgctttgtactaccaagggagatactatcctttgggaattacaccaactgcagcccaaataaagggcattgtggagtggctattaacttgtcatgtggactcaacaggcctaagtactgatagtttggctgatgcagggtatcctgaggcagcttctctgggtgctgctgtttgtgggatggctgttgcttatgtaacttcaaaatatttccttttttggttccgttcgcacactgcgagtgagataaagtggggtggtgcaaagcatcatccagaagacaaagatgattggcagaaaatgcatccacgttcttcctttaaggcatttttggaagttgttaagaaccgcagtttaccatgggagaatgcagaaatggatgcaattcactctttgcagcttatactacgtgattcattcaaggatgcaagtaattcaaagtctattgtgcgtgttcagcttcgggaagaggggttgcaagggatggatgaacttagatctgttgccagagaaatggttagattggtggagactgctacagcacccatatttgccgttgatgttgaaggtcgcataaatgcatggaatgctaaagttgccgagttgacagagttgtcagttgaagaagcaatagggaagtcgttggttcatgatcttgtccatgaagaatcacagacaactgcgcagaaccttctccgcaaagctttaagaggttataccaatctgctttacatttctttcgttccagtaaatcattatctatggagttccctttggctgtattgagagattattctcgtctgctcttcttggtttttaaaaattttagtggcaaagattatcacgggttctagtgatcactacttattcctcctggcatcatgcaacaatatgatggttgcttatatgtttccatccattaaaagtaattgagatcatgtgatagtctttcgtttataggaaaagggatgcccctagggaaggggttgcatgtttggttttacggataagaaactcttagcaagatgtgttctttttacgttcatgttttgacattggcacttttaatacattaaacatgtattatccatattcctgcgtaaactagagcttgcaggttcataaagatatatatactgcttctgataagaattgactaatttataatatcgtaaacatgtgtttaccctgctctgtcaaaaaatttaatattttatcaactgttcacttctctccttttcttttggtttcaaaaaatcctatacattgcctcccatactctctgcaaaaatttccactaattagtgctattatgttagtagttgtgagcccaagttacggcagctccgggtgaaaggggagattctcactatgcacttgaaagttagacttgagcacatatgaagtgttgattagattgtgtcatttagcatgtaacaacttgtgtcaaagctttctgatttagacattagatgagttatgttggttggtcagtttcaatattgatcaactctaggtgatttcagagccatgggtgtataaaatgaagttgcatttaatatcagattcaggctaatcatgacactgggtgtcaacattctttctttagtgtttatgtagcttgagtatattgtacattgtaattgaaactgatttgtatccaccctcttcgtgtcccagccacctacagaaaatgaaagaggagagaaaaacctaatattgttgctaaaccaatcacaggtgaagaagataagaacatagaaataaagttaaggacatttggagctgagcaactgaagaagacggtttttgtggaggttaatgcttgctctaacaaagactacacaaataacattgttggtgtctccttcattggccaggatattaccgcccaaaaagttgtactggacaaatttgttcgcatacaaggtgattacaaggccattatgcacagccctaatcctctgatcccgcccatttttgtatcagatgagaacacttgttgctttgagtggaacactgcgatggaaaaacttagtggttggaacaaagaagaaatcattgggaaaatgttggttggtgagatttttggcactttctgccggctcaagggcccagacgacatgacaaatttcatgatcatgttgcataaggcaattggaggccaggagatagacaagttccctttttccttttctgaccgaaatggaaaatttgttcaagctcttttgactgcaaacaagagagtcaatgtggatggccaaattattggggccttttgtttcttgcagattgcaagtcctgaattgcagaaaactctaatgcagagacaacaagagaagacgagtaacattcacatgaaagagttggcttacatttgtcgggaattaaagaatcctctaaatggtatacgctttacaaattcattattagaggccacagaattgacagaaaaccagaagcagtttctggaaacaagtgctgcttgtgagaggcagatgtccaagatcataagggatattgatctggacaatattgaggatgggtaagttcgtattcaattatttcttctatcgtcccagttaaataaatctgtttactatgacaccgtatactctagtacaactttcaaagtccatgtacaagtgttttatgagttacatgttctagtgatcactgcttattcagctttaatgcaattgttgaagtcaagaaatctggattagttgaatcaggtgagggtgtatacctgtatgacagtatatttccatttgaatatcgaacgtagatacaaagacttcattttttgaacacaggttggtcattaacctagtgttgcctaagcatgtaacgttagaacaattttcgattcattcaatttgtaatgtttcttaccattaaacttgtaaacagttccctggagcttgagaaaggtgaattttttcttgcgagtgtgatagatgctgttgttagccaagtgatgttattattgagggaaagaggagttcaacttatccgtgatattccagacgaaatcaagacattgagggtctatggagatcaagtcagaattcaacaggttttcgctgatttcttacagattatggcaagctatgcaccaccccgggaagggtgggtagaagtccatcttcgaccaagtataaagcaaatttctgatggagtaactatagtacatatcgagttcaggtaactttttcttcttcacttttcccagctatatcaacatgcttcgacctataaaatgttaaagtttttatttgattttttgtgcgttttggtggaaaaggattgtttgccctggtgaaggtcttcctccagaattgatccaagatatgttccataatagtttgtgggtaactcaacaaggtctagggctaagcatgtgtagaagaatcctacagcttatgaatggtcaagtccagtatatcagagaatcagaaagatgttttttccttattatccttcaactaccaatgctgattcaatgatagttcaacaacagctatattcatcacaaaatgtacattatgactgagcaactactgatacaggtattgaaatcatccttgtgctgttgaataataatctgttggtttttgaagcatctactgtaacaggactaatttttataacaccataggcttgatgatatcaagctattgtaattagtattattctaacaaaatttcatagttgtatgataatgtgttaagcattcccttccttttataacaaaaagtaatctgattagatttggcacggagtttaaaaatataaaaaaaaaactattgaatcttgtgattctaaattgaatttaaattaaatatacaaaactgttctttaatcttgtaaccttaaacatattaagtggtaatattgatacttcaagtcactggttgataaaaataagtagaacatatagtattaataagaatagttattattagggatgggcactatttggattaaatcaaatcaaattgaattctaatttgaattggtttatggattcttgatttggttttgaaataataatttactttgtttggttttttgatttgatttcagattttaaaaaaatgaaaatcgaaaagatcaaattatatataattttagctgttttcattatgatttaaaatttatttttttgtatatttagacatctataattgatatactattaaatattgcattttacattttacttgtgatttatattttaaaaaagtatatttaaaaaaatttaatattatttttttaaaaattattatgtttttaattattgacctaacgaattaaccaaaaggaaaaatcaaacataatcaagatacatgtttggtttgaattgaggtacactttttcaaaatcaaaaactgaataatataaaatcaaaccaaaaaattgaatttatacccctacttattatatgagatggataatttaaaaaacaaagatatgaattataaattttactttaatatgataaaa

SEQ ID NO: 335 - DNA, 7322 bp, Solanum lycopersicum
ctcaatatttcaaatttcagtacttcctcttccgtttcgttttaattgtcatctgtacgaaaaaaaatatttatttcaaaacagttattaatttgaacaatcaaaacatattacttatctttttccaattttgtctctaacattaattaataaggaatatatagatcaaataagtctgttcacttttatttgtcatgttgcatttttcgaaagtcaatttaactaattttcaaagttaaattagattatattaatttgatattttaaacaaaaaatttagatattcaaaaactattcaaagagtactataaattgtaattttttgcatatccatatgatgaaaaaatacatcatacaatgtaagtcaaaatttttatcgtttaaatctataaaagaaaactatgacaaatgaaaacagacaaaaaacgtattattttttcataaaaatcttgtcaatcttctcgtgacaactaaaaaaataataattagagggagtattattttaagggtctgaaattgtaaaaatttataatattttttattttaaaatacacgaataatttttttaatttttaattaaaacatactaaagttaaaatgacaaaaaatattcaaaaagataaaataaataactaaaatactagtctgactaaattttctagaactaaaaggatatttccttattttagtttagctaagtatacttgatattctcacttaagagtatagtgcgtatgttatgtttaatgatgtgatcattattaaaactaagtgattaataaattaaatacacgagatatttatataaacttgttctattcaaattattactatagcatctcattaaatattcctcccaaagagaaacgaaaaatgggattggagaattgcatcagtcattactaagaagttaaaaacaatgattaatttgaattcatttgttttattaaattttttcatcgagaactcgaaaaaaatgattagaaagtttataataataaaagattaagtaaaagatattagcacagtatgtattagagaaagggagagaggaggtagacgtgtggagctacaaagagggctcaagcagaagaatcaagtagagtcatgatagaataccagctgctctttgtagttgagttttctctaagaataaaccattttcaagaacccataaaatggagtcacagagtagtgaaaacagaagaggaggaggaggaaggacatccttgaaccagaataagcaaaacaacaacaaagattcaggcttgaatacttcttctgcagctagtaacatgaagaataacgctagtaaggctgcactggctcagtacaatgctgatgcaaagttaatggctgagtttgagcagtctagtgtttctggtaagtcttttgattattcaaaatctgttctttttccaccacatgaagctaatgaagaagaaatcacttcttatctttcaagaattcaaaggggtgggcttgttcaaccatttgggtgtatggtcgctattgaggaacccactttcaagattataggttatagtgagaattgctatgatatgttgggttttaagcctacaaagatgaaattaggtctgattggtgttgatgctagaaatctttttaccccttcttcaggggattcattggctaaagttatggcttctagggaaatttctttgttgaaccctatatgggttcattctaggactacccataagcccttttatgctatacttcacaggattgatgtgggcattgtgattgatttagaacctgctaattctagtgatcctgcattgctgcttgctggggcagtgcagtcacaaaaactggcggtacggtcaatatctaggttgcagtcactccctggtggagatataggggttctatgtgatacagctgtggaagatgtgcagaagctgactggatatgatagggtaatggtctataagttccatgatgataatcatggtgaaattgtgtctgagataaggagatcagacttggaaccttatttgggtttgcattatcctgcaacagatatcccacaagctgcccgcttcttgtttaaacagaacagagttaggatgatatgtgattgtaatgctcagcctgttaaggttgttcagagtgaagaactaaagcagcctatctgcttggttaattcgactcttagatcacctcatgaatgccatagcaagtatatggccaacatgggatctatatcgtctttggttatggcagttcttatcaatagcggtgattcaatgaagctttggggtttgattgtctgtcatcacacttctcctcggtatgtgcctttcccacttcgatatgcatgtgaattcttcacacaggcattcggcttgcagcttaatatggagcttcaattggcatcacagctggcagagaagaaaactctccagatgcagaccttactatgtgacatgcttcttcgagatgttccatttggcgttgtaacacaatcccctagtattatggaccttgtgaagtgtgatggagctgcactttattgtggtggaaaatgttggttgcttggggtgacaccaactgaagcacaagttaaagatattgcacagtggttactagttgctcataaggactctacaggtttaagtactgactgccttgcggatgctggttatcctggtgcggctttactgggagatgctgtttgtggcatggctactgcgagaattacttccaaggattttctattctggttcaggtctcacacagctaaggaagtcaagtggggaggtgctaagcatcatccagatgataaagatgatggaggaaaaatgcacccacgatcttcatttaatgcctttcttgaagtggttaaaagcagaagtttgccatgggagattccggagattaatgccattcattctctacaaatcataatgagagaatcaatccaagagaacgaaaacagctctctaaaaactttgactacttctcaacagaatgatgctgatgggccaagcatggatgagcttagttctgtggcaatggaaatggttagattgattgagacagccactgctccaattttcggagttgatccatctggcttaataaatggatggaatgagaagattgctgacttaacaggattgcatgctagtgaagcagttggaatgtctctcattaatgatattactcatgaagattcacgtggaactgttgaaaaagttctacatagagctctgttaggtacttcttatgttgacttaatagcaatcattaaaatttggatacgtccttaatactacatggctataattctatctatctgctcatggtgttattttatctgcattctttatgcattgcagtcatacatgatagcatatcttcttagatttgaaattcaggcgtactggtaagagaattggctacctacacttattcaattggcctttcatcttgtttgttgtaatatatacgtagttacctgcattacttggggcgatattatgctttcagcattgactagtcggtcatctccactgcatagtagacttaggttgctctttcagtgcactcttttagttaaaatagatatttttcctcgtctgggtaagtcaaaattgactgacagcctgagcacagaagtttccactaacattccccagcttgttctcactccccaccctctctctatctttgtcacttgtgattcaggtgaggaggaaaaaaatgtggaaataaaattgcgaaggtttgggaaagatccaccaggatcagttatataccttgtgatcaatgcctgcacaagccgggaccacaaaaatggtgttgttggtgtgtcctttgtggctcaagatgtcactcctgagaaatttatcatggataaattcatacagttgcgaggagattatgaggctattgtacaaagtcttagtccattgattccaccaatatttgcttctgatgaaaatgcttgttgttcggagtggaatgcagcaatggaaagattgactggttggacaaaatatgaggtcatggggaggactcttcccggtgaagtttttggtggtctttgtcgtcttacgggacaagatgcccttacaaaatttatgattcttttctaccaagcaattagtggtcatgacaccaaaaagcttccctttggcttttttaataggagaggagagtttttggaagtgttcctaacagcaaacaagagaactgatgaacatgggaatgtatgtgggtgtttctgcttcctgcagcctatgacgattgacccagaagcatcagatgagagacaagactctaaagattcgctttggaaatataaagaatatgcttatgtactacagcagatgaaaaatccactgaatggaatccagtttacccataaacttcttgaagcaaccggtgtttcagataatcagaaacagcttctggagacaagtgaagcctgtgagaaacagatactgtctgttattgacaatatggattttggaggtatagaggacgggtaatgcttcttctatatggacttgattaatatgctctttatctttcttatgttttttcaattttccacctcaactagttgtcacttaatgatggagaaaatatcatatatgatctcagagaaccagttgtattatctgttcttctaagacctaaatgggttgttcatccagtggttacaaagaagcagttaccacttaccactgttctttcctttactgcaactcttcccttattgcggcttacattaatttgtgtagattggacactgcatcccgatctcgagaagctgttactcattaatttttaatttcagtagaaacggctttccaaaagtgttgaatcagtttacaggagcaccaaagaaaaagagagagaagtacccaaaatactgcaaacacattaaaacttaaagtcttcttctaaaatctactgtaaacgactctttgtatttgctagtgcaacaatgagccaccataatatatgtatgttgatacttgcttcttcgtttctctttctattgtttctctatggctgaaaggtttgctaaatgcacattactttttcctggttctagcagcaaagtgcagctaaacatggaggaattcgtgctaggaaatgttgtggatgctattgtgagtcaagtaatgattttcttgaaagaaaagaacttacagctgctgcatgatatccctgaccagatcaaaactcttcctctatatggtgatcaaattaagcttcagcgtgttctgtcagatttcttgcttagtgtagtgcaccatgcaccttctccggatggttgggtggaaatcaaggtgttacctggtttgaaacttatacaagatggaaatgaattaatccacctccagttgaggtaacttcactgctatttatttattgatggtttgttacataagggcatgagcttacccattttatctggtgtctgttttcatgcaaccgtgcaatgtataatgcctaatcagttgaagtgcttcgcggagtttaatctaatcattgggaatattatggtgcttcattcacttagctgaatttgtttttttatcaagctctttgaatcttcaagtgaggagtagaaaatcaggaagaacattgtcaattgtcttactttgtaacttaaacatctttgtcataatcagcgaaaccaccttgcatagcctttcagtaattatatgtatgtatggaagttacttctattgctaaatgtttatgtgaaattaaacacactttattttctagaatgactcaccctggccaaggactacctgctgctctaattgatgacatgtctggagaaagaaatagatggacaacacaagaaggaatcgcgttaaatgttgcccagaaacttctcaatgtaatgaatggacatgtccgttatgtcagaggggaagacaaatgttatttcctaatcgatgtggaactccaaacatcgaagcctacacaacatggtccgaaattggaagttactcaagaaatagaaatctaaacaaacgtgatccaaatttggatgcaggcagagtgtcctatctcaaagtacatttaactcttcttttcacttcaggtaaatctcttttttttttgtaataagaaaatatgtggtatttctagagcctgtgttgattctggatcccctaccttgtacataattatgattattatcagcggtataggatatattttcatgtggatgttgtatattgtttgtatcaagaacactgtaagactatcttctcaaataaaatgatccaacatgttatgctgggtagaagagttccattcatttgaatgaattgaccaaatattccccaaatcattttaagacctaagattaaatatcaaataatatgggaaaagtatattgaccattatttcttaaaatgcgtgttaagtctaaaatggacaagtaaaaacgaagaaggagagtatcaccggaaactacagtgtgcacttttgtatatagtaatatatcaggcaaggtatgtacagggattgtaatgtctacatgttcttctttactagtgcactagacatccaacgcgactgtgtattggaaatttaatgtgctatacctcatcaaaagcgcaattgttatgtgtgcatgcatctcgattcattcattgaataacatgctataatgatttttactcactatccaaacgaccaattagagattcgtaaaacgtgaatgcaaaaagcataacattatttcatatgcttttttaggttttccatttaagcttctaaaataatctgtaagatagcatgcacgtaaaccttaccctaacatagggaagtagaaaagctcaagtaacagactaaaggacatgtaagcttctaaaattatttgcaaagagcataacattatttcatatacttttttaggttctccatttaagcttctaaaataatctgtaagatagcatgcacgtaaaccttaccctaacatagggaagtagaaaagctcaagtaacagactaaaggacatgtaagcttctaaaattatttgcaaagagcataacattatttcatatgcttttttagattttccatttaagcttctaaaatagtttgtaagatagcatgcacgtaaaccttaccctaacataggaaagtagaaaagctcaagtaacagactaaaggacatgtaagcttctaaaattatttgcaaagtagcatgcacgtaaactttactctaacctagggagctagttaaattgtttccatttgagagacactcagctcgagtaacagactaaaaggacattgcaagttaatagaga

SEQ ID NO: 336 - DNA, 4818 bp, Solanum lycopersicum
ttttcgagctcatttttttgtaattttgtgcacctttttacttacgtgacatttaaatatctctcacgtactttaactgtgtggattcacggagcgtgccacgtaagacagaaggtgtacaaaattaaaaaaaaaaagaataagttcaaggataatagaatttttatttaattaaggtatgtcttgagatttcgatcatagtctagagaatacttgtgcctaatcgctaaaagaaatgataaatatggggggggggggaaacacctccacaaattttttgaacatcaaattcatttgtttttaactataaaatatttttttcaataattaaccttaaaaaatatttatgtcataatttgaattttaatattatatattgacataagacaaaaatatgctctttaacttcgcttcaactcatatatatttctttcaactttgagtataaataagtaaacattatatttgtataaagtcgaataaataaacacacacgtctaatttatgtcctatgcgtattgtaacagatagaacgtatgtgtctgcatacacgtaattgaaaattgaatagcgtaaatttaaaatagtcaaacggcacatttacgtaacaaaagaaaagttactcttaacattaatgttttttattcaaataatataccatctttattaagatttttgttcgatttttgacattcaaaatatatattatgacaaatatgacgtgtgtgtctgtttatacataataaataaacataataaaagttgaatagcataaatttaaaatagtcaaaagagcacatttatgtaactaaaagaaaaatttacttttaacatttatatttttattcaaaataatttcgattctcgaaattcgaaatatatgtaatatataaaatggaaagaagtagtaatacatttcatcatctttgttagttagttttactttcattcaaattctctctgttcttcctctgtttttgctttttactcaaacacagccatgattaatggcaaagacatatatgatgttcttgctgcaattataccattatatgttgcgatgatattagcttatggttctgttcgatggtggaagatcttcacccccgatcaatgttctggaatcaatcgattcgtggcagttttcgctgttcctctgctcggtttccatttcatatccacgaacgatccttacgcgatgaattaccatttcatcgctgctgattcccttcaaaaagttgttatacttttcgcgcttttcatctggcatcttttcagcaaaagaggaaatttagaatgggtgattactctgttttctctttcgactttgcccaacactctagttatggggatccctctgcttaaagcaatgtacggagatttttctgggaatctaatggtacaaattgtcgttatgcaaagtgtgatttggtatacacttatgctttttctgttcgaatacagaggagctaagttactgatcggtgagcaattccccgaaactgcagcttcgattacttcgttcagagttgaatctgatgttgtttcactcaatggacgtgaaccattacaggccgatgctgaaatcggagacgatggaaaattacatgttatagttcgaagatcctctgcttcttcaattatttcatcttataataaagggatactgcaatcgaataacatgactccgcgagcttcgaacttgactggtgttgagatttattctgtgcaatcgtctcgagagccaacgccaagagcgtctagttttaatcagacagatttttacgccatgtttgctagtaaaacagctagtccgaagcatgggtatacgaatagctatggtggagatgtgttttctctgcagtcatctaaagggccaacaccgcgaacttctaattttgaagaggagatgtcgaagattggaagtaataagaagaatcgaggaggtatctatatagtagtaatataatggaacatattgaacttatatcatcgtgtctttctgattatataatatgtctcgacaggtaggagtatgagcggagagctatataatagtagtagcactgcttctactaatggattggtgtatccacctccgaatccaatgtttgtagggcaaaggaaaaaggaagttggaagcggaagtggtgtaccaacgccagtgccagtgccagtaccagtaccagtatcaatgtcgaatagtaatagtaatagcaatagtaaagagcttcatatgtttgtttggagttcaagtgcttctcctacatccgaaggtaatcataagcacgcgattagcaaaggtggttcaagtgaacttggagttcttgatgcatccaaagccgttcttcaacaagagatagctgcagcaagaggtaatgaaacttaaactgtttgactctcgagaaatgaaaagtgtcatgagacccgaagtcctttttttgcttttgtcatgtcttttgtctctagcgcatgcaaaagattgaaataaggtgtccttttcaccttttttggcttcttgttataagtatattgtacttgtttactttactttagttgacattcttcaacccatcaagtacttttagattgataaagaataaattttgcatacatacaagtttttcaaaacattgatctcacttttattgaatcaactaccaacttaattgcatcagggtcttattttaaaagtaaaacgctctctgtttgaatatgagacttcttgttgttgacttgtgttcgttcgtgtattgactcaattgatatatagagaatgcaagttcggttagtaaaggaaatgtagacaaagaaatagagatcgaggatggatcgaagaatatagaagatggagagaagaaatcacaaatgcctccggctagtgttatgacaaggctaatccttataatggtatggaggaagttgataagaaatccaaacacctatgcaagtttgatcggactcatttggtctctcatctcgtacaggtatttcaaacacctacgtgaacttttaccttattggtgagcgttcaccttgatggaatgtaattgttgtcaatctttttgcagatggaatattcaaatgccttcaattgtgaaaggctcgatctcaattctatcagatgctggtctcggaatggctatgttcagtctaggtatattgacattgacattaaagtctttaccaacattagctaagtgtcattagaaccaatgtcgctaaaatttttagaaacatgtacaaagagtgttacttgccgctaaagatgcatatttagcatatatatacatagatatacactcttacaaacacaattatactacttatgtgtaggtttattcatggctttacaaccaaagatcatagcttgtggaaaatctgttgctacattctccatggcagttaggtttttaacaggaccagctgttattgctgctacttctatcgcgattggtcttcgcggtgtattactacatgttgctatcgttcaggtatatatatatatatacattaacgataacaaaattacaagtttaccttatatatactgatgttaatggacttatatataacttgtaggctgctttgccccaaggcattgttccgtttgtgtttgcaaaagaatacaatctccatcctgatatccttagtaccgcgtaagtactttcatcgtttaccatgaatttaaaattttgaatctgcttctggttcgtaatgttgattattttaaattgtttttatttggcagggttatatttggaatgctagttgctttaccaattacaatattatattatgtgcttcttggtgtgtagacttggggcatggggaatagagagagataagttcaatggattcaacaatatggaaattaccatgtgctccctaccatgtgactatttaattaatattattatacaaaaaaaaaatgcattaatttattttcattctttttctttaaattttagtttgtttttttttataattttaattatagttagctagctaggaagaattggtgatcaatagtactagaattattaattttatgttgaattattactttcatttttactaagtaatattaaagttgtagctagctatttcagatctaattaaacatttaagatattgtttcagtctaacgacattatttatttaactaatttataaaattcacctcgtactcagaggcaggaatcatgattatgagtttgagaagattatttaattttgatgaaaatgaaattctcgaaactcagtgctaatacatttaacacagttacttctttatgttaagcctcaattagcaattataagatcggtatatctttatcttgaaaaaaaaatagatgcaaatttatttaaaaaatagcttaaattaatagtcgaattatgaattgttatcgatcacttgaatttaaaaaagtattttactcttttcgctttataaaaatagaagtcaagcgaggtggattgatccttttttcatttttgaggaaatattttattttttattcatatgatgtaacgttgcctatatttgactatttgatgagttgttataaatatttctgcatgcacgtgaaagcttaaattaaataaaatcataatgggaaaaagagaaaatttagcctcagtgcattgttccaagatttactattcttattatttttaaattatgtatatcatgtgatatgcccttaagtaggaaaatggcaattgaacacttttaaatctttactcaatattattttagaaaatttcggaaatagcaaatataatagacatgataaaagtttataattatagttt

SEQ ID NO: 337 - DNA, 5713 bp, Solanum lycopersicum
ttagagttcggagcctaaaggtataaaatattaacaaaaatttcaaaatagtatataaaattttatattaatcaaaatgataaaatcgatggaacaacaacgatttcctccgctgaaaaaaataaaatcgctgctacttcagcgattttctttaaaaaattctttttttaaaaaaaatcacattttgcaaaatcgatgcagtagcagcgaattttgctttttctggcgaagaaatcgctgttgttccagtgattttacagttttaattaatacaaaattttatataacactttaaaaattttattaatattttatacttttaggcttcggagtataaaattatgtcaaacagacaacccatgccaatctaatacctgccactctcattcccatgccaaacctatttattctatatttctaaaaaaggacaagttccaaaattcaagaaagaatttctcaaactttttaattaaatttaattttaaagaatataatattacattttataatttaatatactatagtaagtgaaaacatttttatctcatcccatcaatcataataatgactaaaagcatcgaaattaagtattaatttttatttttatatattgacagtataattttttttgtttaatgtattatttaaatatctaaaagattattattattattattgttgttgttgttgttataatagataacttttataaaagttgaattattaataatatgaaaacagaaaaagcaagacatgttatatgctctaacgtgtatataagctaagctaaaccttctttatctttgtccacatattccttggcccctactttgtcccaaatttcaagttcaatcacccccacttcccatttttacataaaaaattgtaaaataaataaatattttttatataaaaaaaattaacttatttatattttttgaaattttgactgtattaaattaaatacatgttaaatatatcaaaataatcttgctgttttaaatatgttatatggaaaatgttgttttggagccgactaaagttaagttttacattaacgagtaaaatttcatatctaaagctcgaaatttctgatcagaaatgaaggagtgattatcgctctacgagaattcttttcccactcactcttttgactatatatataagtcctcttacatgtacatccttatgttaacttcactcttttctacttcatctttcttccccaaaaaaaacaaactaaaacaacaaatttgtttccaatttttctcccaaatcacaaacaatgataagttggcatgatctttacgtcgtcttgacggccgttgttccactttatgtcgccatgatcttagcctatggctcggtccggtggtggaaaatcttctcaccggatcaatgttcaggaatcaatagatttgtagctattttcgcggtcccattgttgtcatttcacttcatttctatgaataacccttacgaaatgaattttcgattcatcgcagctgacacgttgcaaaaagtgatcatgttgatagtgttatgcatttggtctaacgtgaccaaaaatggaagtcttgaatggagtataacgattttttcgctttcaacacttccaaatacacttgttatggggattccattattgatagctatgtatggtgattattcaggtagtttgatggtacaagttgtggtgttacaatgtataatatggtatacgttgttgctatttttattcgaatttcgaggtgctaagatgttgattatggaacaattcccagaaacagcaggggaaattgtttcattcaaagttgaatctgatgttgtttcgttagatggacaagattttcttgaaactgatgctgaattagggcgagatgggaaacttcatgttacgttacgtaagtccaatgtgtctagaaggtcatttgctatgacccctagaccctcaaatcttaccggggctgaaatttatagcttgaattcttctagaaatcctaccccacgagggtcgaatttcaatcacagtgatttctacgcgatgatggggtttccaggaaggttatcgaattttggtccggtcgattcaactcctagaccatctaatttcgaagaaaattgtgctcagggctcccctaaattcgggttttaccctgcacaatctaattatccggccccaaatccggaaattgcttccatagtttctataaacacgaaaaatcaacaagtacaataccagcaccagcaccagcaacaacaaaatggtaaagctagtcatgatgctaaagagctacacatgtttgtgtggagctctagtgcttcaccagtatcggaggccgcaggcctccatgtgttcggtggcacggattttagtgccaacgaacagtcttgtaggtctgatggtgctaaagaaataagaatgttggtacctgatcaccctcaaattggggataataaaggtattttttatttattttttacgatattttgttgactggtcaacttatcgcaacctttttatattatttgattatatatatatatatatatatattttttgaagacgtttctcaagattttggtggtgaagaattcagctttggtggtagtactggtggtggtgatgaaaagagtaaagacgaaaagaaagaagaaaaagaaggtctcaccggagtacacactacgactaccggagttcaagattccggtaccagaaaacatatgcctccagcaagtgttatgactcgtttgattttaatcatggtttggcgtaagcttatccgaaatccaaacacgtattcgagtctcattggtttgatttggtccctaatctcgtataggtaaagctaatcaaatgtattaataaaattattaattttcacttatcttgaaacattttaaattaattaggcgaattttttttagatttttgatattaattaagttttgtttttgtcgtgtttttgtaggtggcatgtgcatatgcctaaaataatagagaaatcaatctctattctctctgatgctggccttggaatggctatgtttagcttaggtgagtagtcaaacttgataattaattcgtataatttgatggatgaaggttcgattctcgtgtaagaatctaaaaaagaagagaatacaaatatatcataatgcttaactaattaaatctatatttcttcactatccatacaggcttaatcaaatagtattagtaagagtagacgttgaaattaccatcagcaattatgactacatatttctttcatttttaactaaatattagaaatcgagctttatatatgattttgtgtttaataggagatatttttatgatattattaaatttttcgatataaatttaaatttgatcgaatttgaacatcatgttgtgtggtaggtttgtttatggcccttcaaccaaagataatagcatgtgggaacactgtggctacttttgcaatggcagtaagatttctaactggcccggcagttatggctgccgcttctattatcgttggcttacgtggtacactccttcatgtcgcgattgttcaggtaataacggagtaagaattttaatttttaaattttaaaaatttcaatttttaaaaaaaatcatattcaatttctaaatttatatatattaaataacattttgaatataaatacaaagtctgagttaagttacaaaatgaattctcgaagaaattagagatgtattaggccaatgcattagtgtaacgcctagaagtcacgataacaagctatcgtgatggacctttctttaaataaattaaagtaatgatttatatatcagatattaataaaaagagatatattacattttattatgagttttgaaaaaattaattatgttttccttttttgtcattctagttttataataattctttctaaaattctttgaaatgtcatttgttaattaattaggctgcattgccacaagggattgttccatttgtgtttgctaaggagtacaatgttcatccggctattcttagtactgcgtaagttaattttctcctagttaatttaatttcttaaatgttaattcaataatttaaatttctaattaatagaatatttctttctttttggaatttcagggttatttttggaatgttgatagcattaccaatcacattagtctattatattattcttggattataattcaaaatcaatttagcgtgtcagttttttgattgattgattcacggcatagtgaactatatgcgatgaacatgatcaagttagcaccgatcttttgattcgttgagttcgtatacatgatcaactacgcgatgaatcggatatttcgaaacaagagggattttgagtagaagaggttatgtcaatattgaattagatagaaactatcttatctatgaagagtactcccaagtcataagcatttggagcttagacaacatgtttgacttaaattagtttgagatccatgatttaaggatatttttgtctttatttgaagaaattaaagtaaacatttcatccaattagtcaaaattggaggaaaaacaaattgggattagtctagtatgaaggggacaaggaggcaaaattgatgattattgtctagtttaatttgtctccataatttgtaaaaaaaaagaagtccaaaacaatttttatgtataattgagattgattttgagcttttgacttttttttttaatgtggagaaatggttgattttcaatttttacatatttctttctttaatttttgatatatcattacttaattttagtgtatagttttatagttgtgaaaatgatgttttgaaaaaagagttttagcattctaagtttttttttgaggctccgactggatcaagatcgtgtattgcaggacttatttaaaagtgacgctttcaatataattttcttcatattcaaagctcaaactcaaaatcttatttgaaggtgacgttgcaaataaaattttttccatatttaaagctcaaacttaaaactaactctaattaagaatagaacaatttcatctctgcaccacgatgcgtatagaatttagcatccaaagttaaaagcttgtcaataattgatttgaaaagatacaagcttccatctcataaatagaaaaaaaaacaataaatatgcaaaaaagaagagggaacaaacatggatatgagaaacaaaaatataaagtatatctttacttaattataagtagatcatatatatcattttcttttttgcaattacggtcccttatatttggggtagattaaaaatagtcctttagaatatatttttgaatagttttgatttttaaattcgtcaaaatgagacttatgatatttttcaaatatttcataaattacttcatctgaatagacggataaaatttggagaaattgttgttagtgagatttaaacgagtgagtattgattgtgtgtatatattcatttgatatgaaattgttaggctatgacgacttgttatactaagcatcttcataatatgttattaaatccttttatatatcatttttacttatagatacaacatttttctttcgataaaaatatttaattaaacaccctaacaatcacgtagctccgactccgaaacaaacaacaaatactaagcaaattgctggatttggttgttttggactggcattgctatctcttgtcat

SEQ ID NO: 338 - DNA, 5779 bp, Solanum lycopersicum
attttcactctctttcatcaatctccctatccatcgtcattttatttctttcttccttctctctactatgaattttaccattaaatcattaaaatcgaaatctgaagcaacaatttgatatttgtgtctatttactcattttcaaagtcatgtatttattataaattttaatttattttatcttctaatatttaaaagtaaagtaaaattctattgatttggagttctaattttctttcgtggctagtgatttaaaaagaatatttgtatattgttgctcaaaaaatgacatgaaaattattatttttaatcgcttatatttgaaaattcaataatataacaactttgacacaaatgaaaagagggtttatgctgtaattttgataaaccttaacgaggaagaagatgagaaagagattttttggatcagattgaaattattgatgtattcggcacgttattaatatatgcgaaatattattaaattaaaattataatgtatttatttttttagtatatctaattaagtatatatgtatatgaacaaatatacacacgcattggagatttacgcatgtatcaggcatgtagcatatacgacatatgatgagtcttaaaagtatatgtatgtagttttttttaatcaatatatctaattaaatatatatgtatctaacaaaatatacgcatgtatttgaataatagttcgtacaaaagtgattttttaccttaattaatgacacttttagtcatatttcttaatcaaacatgctcctttcttaatgactttcaattttgtatgttaattagacacatgaatttagtatgagtctcatacatctgagatttaaaatatgataaataatataatattataaattagcgtaaatttaaataatttaaatctaaagtaatcaactttctatcgaagagggtttggatgaccctatcggtacccctcacttctcttccctatatataaatcttccacattttacaccttcatgtaatttcactcctttttcttctttcctcttccaccaaagaaaagaaaaacaaaacaattaaattttctcatcagtcctttttaatctctctctgcaatttgctgcagaattcttctgcaccagtactgcagtatcaactgcaatacacacagtgctgcctgcagttaaataacggttttttcttcttcttcgatttgacaattttcttctctttttttggcgaaaatgatcacttggcacgatctgtatgttgtgttaacggcagttgttcctctgtatgttgctatgatattagcttatggttctgttcgttggtggaagatcttttctcccgatcaatgttcagggatcaacagattcgtagctatttttgcagttcctttgttgtctttccatttcatagctatgaacaatccatatgagatgaatttccgtttcattgcggcggattcgctgcagaaagtgattatgcttgttgtactttcattatgggctaatttaactaaaaatggtagccttgaatggagtattaccattttttcactttcaacactaccaaatacattggtgatgggtattcctttgttaattgctatgtatggtgagtactctggtagtctcatggtacaagtagtggtgttgcagtgtatcatttggtacacacttttgctttttttgttcgaatatcgcggtgcgaaaatgcttataatggagcaattcccagaaactgctgcttccattgtttcgtttaaagttgaatctgatgttgtatctctagatggacatgattttctcgaaacagatgctgaaattggtcaagatggaaaactgcatgttactgtgagaaaatcgaatgcgtcccggagatcgttcgctatggatcatcggccgtcgaatctcaccggagctgagatttacagtctcagttcttcgagaaatccgactcctcgagggtctaattttaatcataatgatttttactcaatgatgggatttcctggaggaagattatccaattttggtcctgcagatatgtattctgtacaatcgtctcggggtccgaccccgagaccatctaatttcgaagaaaactgtgctccgggaggtctagttcagagttccccgaggttcggatactttccgacgcagcagcctgcgccgggatcttatcctgccccgaaccccgaaattgcatccgcagggcctaaaagcacaaaacctcagcagccaaatgtacaaacgcagaagcaggaagtacaacagcaacagcagcagcaccaacagccaaatgctaaagctaataatcatgatgctaaggaacttcacatgtttgtatggagttcgagtaattctccggtgtcggaggccggtggcctccatgtgttcggtggcaatgatttcagtgccaacgaacaatcgggtcgatccgatggagctaaagaaattcgaatgttggtttctgatcatactcaaaatggagatagtaaaggtacaactttttttattttttactaattaactcggaatatacactatttaaatatatttatttttaaaaaaaagtaaattcgccagacaaggtgtcttaatattattttaatatatatttaaataatttcatatttgaagccattccgcaaataggggaatttggtggtgaggatttcacttttggaggtgccaatggtggtggaaaagatggcgatgaagaaaaaggcgaaaaagagggacccactggactgactaaactagggtctagctctacatcggagctacaccccaagctcgctggagtacaagatgctggtatgggaaaacagatgcctccggctagtgttatgactcgtttgatcttaatcatggtttggcgtaagcttattcgtaacccaaacacgtattcaagcctcattggtctgatttggtctctaatctcattcaggtaagctaattattatggatttaaaaaactaattactttcttaactttctcatacatttttagttgattagtgggtaaatttttaaaatttgtccatcaattaattagttcttttgtttgttttttagatggcatgtgcatatgcccaaaattatagagaagtcaatctccattctctctgatgctggtcttggaatggctatgtttagcttgggtaagtaaatcgtatcgagttttaaatatattattcttatcattaataattttatcgaacttgtaaataaaattatagttacgtgatacgaatttttgaagctagtattgtcaaacatagcatttatatttttcaactatttattgtaccttgctttctctttcatatgttaaaccatttctagtacgttaagttttacaattttgaccatcaaaacccaatggtagtattaatagggtagttatattatcaaactcatagtcatcgtggggtccttacttgacttaatcattggtttggttactagtagttgaaatttaatataagaagtttcaacagctatctaaatacatcagagatggattcagaatcttaattaatctgtggatcaaaaaagtacaagatttaaacttatattatttcatttgtatagttaaaagtaacgaattcagttaaatttacgagtcacgattatgcgtaggtttgtttatggctcttcaaccaaaaatcattgcatgtggtaacacagtggctacatttgcaatggctgtaaggtttctaactggcccagcagttatggctgctgcttcaattgctgttgggctacgtggtactcttcttcatgtagccattgtacaggtaaattttttttatccatatagcctttttatttttaatatatagtttttggtggtcatgaaatgacaaatttattatctattttattaaatgttgcattaaaattgttggttcaattttattttttttaaaaaaaataatttggtatattgaattttaggctgcattgccacaagggattgtcccatttgtgtttgctaaggagtacaatgttcatccagctattcttagtactgcgtaagtaaaattattttttgatatattataacaggttaaattacattacaacgtatataatcgtgcaataatttataaattttttcttcgtatttcagggttatttttgggatgttgatagcgttgccaattacattagtgtactacattattcttggattataagaatatatgccaagtgaagaaaggaggaaaaaaatagtgggaatcattaatggtttaatcaattcatgggatgagaattaattaaaattactcatgaaaattcccagatatttggagcattaggacaagaaatttgacttaaattagtttttgaagcctccatttgaagaaaaaaaaaatatcaaaaatgttgcaaaatttagaaaaagaggagacaagaaggagcaaaacatggaagcaaaagggaagattaattataatctatagtctatattttctttcccataatcattacgcgtgtgaattatcaatttgaaaaaaaaaaataattgtcaattagtagaaattcaaattgattttgactttttaatgttaggtttttagtacttttttttgtttaattaaccaatcgtatcgtgtgtatttatttatttactcaggtaattattgtaatagtttggtttgctagttgtttacttccattgtaaattactttagattcttaaagactatatccaaaaatctcatgttacatgttctagtcgtgaaatcaatagatcaatttatatttatcttaattcaataagaatatctgattattttttgtcgtgttatgttaaaaaaaaaaaaagatttcatgtttcttgccattggaatatgaaaatgatgtattcataaaaaagagagacatttcacattcaaagttaagaattttcacctcaaaagaaaaaagtagcattagatgctaaaagagttgtgtttataaaaaaggaaaaaaaaggaagaggaaaacattgggtggatctttgacattaaattttattatattttccctattaaggctacaatggatctttgcaatttgcaacttttttatttatttattgaatttggcaacaaagcactttaggtgtgggggctttaattgagagcaacgtgagataactcatatacaaagagaaaaagaaaagagagcacaaagctgcatgagtcaaaagtgcttttgatctctatattgtcgaaataatgattgtaaaaacgaagattatgatgaaatgaatagaaattttttttatatgttatcaaaatatatgtgcgtaaggagaagcttagattcaggcttgctcaacaaacaaacaacaatatatatgaaatttcacaagtgaggtctgacaaggatataacgtacgcattttcttacaccatagagataaaaagtctcgaagaaccttgatgattcaattacaaacatatcaaaataactaaataagtatgaaaaagggaaaatgacattggagaaacgaaactaaaatcgatatatgcttgctcgaacttagttattaaacacttaaaaacgtatttcttcgttaaatttttttaactccatcttaatactgaaatcttaagttgaagtcctgataaatattgaacatcgaacgagaaactaaaaagagaaatgatacataatgaacaggatgatgatattgatcgatgtgcccataatcctaccctactcctaacccaagcatgggttgtaatacaatgaacatatcacctcaaaagctgtcttactttttt

SEQ ID NO: 339 - DNA, 4760 bp, Solanum lycopersicum
actattgtgcccactccttgcaatattattgcttctttgtttaaagttaatgtatgaataaaatctcatattaataattaataataaaaatttatgtaagaagtataaaaattttaatgatacaagacgtttagtaaaacaaaatcacacaagcttagttcaaaataaatgatattacacctcaatataacataatttaaatttaatatgattatcaaatatcaaaaatataaatgaatctttttaatttttcatctactattcaataattatattaaacttgaatttacatgaaaaaaccttgcatgagataaaaaataatctcttgataaagatagttccatactcataaaattcaaatttaaaattatcataacgaatcatgaagaagtatttatcatttcaatacgtttacgagtgtttgtatcataataaaaagactaaaaagaaagcttcccgaaagccctcagcttttatatctttgtctgccattgaattcccataaacaaacaaatcactatcacataaattcccacaaaaacctcgtccttctactctccttttttttttttttctatacaaattttcctcttaaataacacttgtttaataactactatatactatttcattcttttgaagaaaaaaaaaaagaactatttttagctcattgagttattactttgtctcacttgcctagttgagagttaaagcagaaagagaaaaaaacacaagttgtttctgtttctggggttcattaataagttctttgaatgaagaaaatgagtttcatgtagtaaagtttgaatcttttttgtgttttttccattatttaggtacacaaagattggggtttgttctgtttttaagctaatcttggaaaaaagaagaagagtgtttcatgaaggaaagtttgaatctttattgtgtttttgtgaaccccatttgatttttgtgcttcctaaagtcatattctgatattctagagaaaaagaagaagatgataacagtttcagacctttatcatgttctaactgctgtagttccactttatgtagctatgatattggcatatggctcagtaaaatggtggaagatatttagtccagatcaatgttcaggaatcaatagatttgtggctctttttgcagttccattgttatcttttcacttcattgcttcaaacaatccttatgccatgaactacaggttcatagcagctgacacattacaaaaagttattgttctggttgttttagctatttggtcaagaattagctcaagggggtctcttgaatggtccattactttgttttccctttcaactttgcctaatactttagttatgggaatccctttgttaaaagggatgtatggtgatgcctcaggtagtttaatggttcaaattgttgttcttcaatgtatcatttggtacactttgatgcttttcttgtttgagtatagaggtgctagaatgcttattgctgaacagtttcctgatactggaggatcaattgtttcatttaaaattgattctgatgttatttcattagatggaaaagaaccattagaaactcaagctgaagttggtgatgatgggaaacttcatgtagttgttaggaaatcagctagttcaaggtctgaaattttttcaagaatgtcacatggtcataacactggtggtctttccatgacaccacgaccatccaatttgtctaatgctgagatttactctttgcaatcttcaacaaatatgacccctagagattcaaattttaaccataatgatatatactcaatggtgaatgggaaaaataatgcaaatatgagtcctaggacatcaaattttggtaacttgggatttgatgaagagagtggatttgggaagactaatgtagggtaccctgcacctactaatgctgggattttttctccggcaatcggaccggggacaaaaaagaaggctaatgggacagaaagtggaaaagatcttcatatgtttgtttggagttcaagtgcttcaccagtatctgaaggagggattcatgtgttcaggggaggtgactttggtaatgagcttggaattggacatcactcaaaaggttgggcacacacttaaattatttacatgtctaaaaactcatgtcatttaagtactattttgtatttttgttggttttggttatgttgtcttgaattttaagttattaagtgcaatttataattaataattgattttgtactcttttgtgcattagattatgatgattttggccgagaagagttttctctcagggataaaaataactccaatggatgtcatcgagaagagccggtgctaaagaagctaggatcgagttctacagccgagctgtttcccaggactgctactgaaactaaggctactgctatgcctgctgctagtgtgatgaccagacttattctgattatggtgtggcgaaaactcattaggaacccgaatacttattctagtctccttggtcttgcttggtccttgatctcattccggtttgtacactaaagtttccttgacataaacgtatttcaatactatgtttgaatctcaaactagttgtagtcggctatatgagtcatccgcattccattctggcctatttaactcaattactagataattgctatggtttcaggtggaacattcagatgcctttagtttttgctaagtcgatatcaattctctccgatgctggtcttggaatggcaatgtttagtcttggtatgacgtttattcttactaacattcacaatagtactcacgattggcctatgcttatggtaaaattaatggttgttgaaactcatttgtttccataaactttaggtttgttcatggcgttgcagcctaaaatgatctcctgtggaaaatcaattgctgccttctctatggcagtgagattcatcagcggtccagcagtcatggctgctgcctccttcgctattggacttcgaggtgttcttttgcatattgcaatagttcaggtaaaggttctcctatatgcatattcaatgtcgtcttttcttttcattactacgtcgatttgctgcattatttgaactgaggacccttcggaaacaacctaactacctccacgaggtaggggtagaggtaaggtctacgtacacctctaccctccctataccccatttgtgcaatttcactaggtatgttgttgtaattgtttcgtatatttcaggcagctctacctcaaggaatcgttcctttcgtctttgcaaaagaatacaatcttcatcctgatatacttagcacagggtaaggactctcacaaactcatatatcactatcaacatttcttacaccttacgtgcatttcgactagttccaacgtattattcacctatagtgaagccattatccgattttgatttggtttatcacttgtcattgcataaaacttaaaactcttcatttcgttttggtcctaaaagacaaccacgatgccctatattgttgctcgaactctctaaaaatgaactacttctgaacaatccaacacaactagcaacatttttgaaagagttcgagcaacatatatagacgttgcatgaagcatatacactttagtaataacttcatatttttttcgggtttcgatcgattgccttgtaatattggtattggtgattttgcagggttatatttggtatgttaatagctcttccaatcactttggtttactacattttgctggggctttagagtaaagctgtaatctgaaaaggaaatgactattttgccactgctttttatgcttctaacaaaattaaatttattttgttttctcttaattatcctttctagctttgaaccttttgtattgtgtaatgttatttactaacttaattagttttgaaccttctcatttctatagtttaggaccttttcggaataaaagatatgtcagaattaataattaatcgcaataagttatcccgatcagatattattagtttcgtctctttaattattgacaactttaaaaatattcgtatatttgactaactaatttcgtctcttgattaagtttgttaataatttaaaaataaaactaataatttacgtaaaattcgaaattttgtttccctctggctgacatattctgaatggcgtgcttcatgtgtcttttgatttttaactcaatttgttatttctcttttgcgtggtccactaatttttaacttatatcataaaaaagtggaagaatattccattaattgggatcatcaaattgagaaattttcaaaattgattgtttttttttctgttctgtacatgatatggtataatataatgttataaaaataataatattatttgatctatacatggagtatgtaagtattcacttacaaaaagaaatacttttgaaatatgaattataatattactcatttaagttattttcacgactcgaacatgtaagtccgtgacataatgacaacataattaattagtgtttttatattagaatttagaactaaaaaggcaaggctaatttcttcgtttcagtttatttttgttagatttacttatattcgttaagatcaagaatgtatttgttacaaaaaaaaataataattatttttcgcataatttttcgttggtcaatatattttgaaaactatcatttttaggaaaataaattcttaaaaaaaaagacaaatatgacttttttaattaaaaaaacaagaaaaaaaga

SEQ ID NO: 340 - DNA, 4877 bp, Solanum lycopersicum
aagttgcttagcaatatgtaaatttaatctaataaatttgtgtaaaacaatttaaactacagtttcatttctttagtttaataattatcgttcatgttctaactagcatgtatgaacatatgaaaggtttaaggttaatttctcgttttataatcttggacaatcgttactctttaagctaattttttcaattgtaataaatttaaagtaaaatcgtattaaaattaaataaatcaaattctcattttatctgatattaattcatacataaaatttagtcaagcttaaagttcatttccaacattgatagaagttaacaatattatgacatcaacaaagaattatcacacttcttgattgaatatttatttatttgcattcattatcattttccctttctcttgggtatttatatttttatattataagagaaaggagaatttacctatttatccaacaaatattaaaatgtttttatgtgttcatagggaggcctctctctcatcatgaaaagacttactaaaaagaagaagctttttccaaaggaccttagcttttacttctttgtctgccatttaatttccttaaatatatcataactcttctttcatctcccacacaaaacaccacttctttttttcacttctcaacactctccctttttatatacactagtagcaagtagctctttttctagctatatctttctttaagctaagaggggttctcccatttcttagtttttattatatagaggtgttgaaaaaaggagaaaaagtgaagtggggttttgttcttgaaggaaagtttggatctttttgtgttcttgaaaaaccccatgtgagtttgtgatcaaaaatccattttgttttgtgaagggaaagtttgaatctttttgtgttcttgcataaccccatgtgagttttgtgatcaaatacccatttcttgatctgtactttgttttgtgaagtgaaaagtttgaatctttgtaagaaaaaaaatgatatcactttcagacctttaccatgttcttactgctgtagttccactatatgtagcaatgatcttagcttatggttctgtaaaatggtggaaaattttcagccctgaccaatgttctggaatcaatagatttgtagctctttttgctgttccattgctatcttttcatttcattgcttccaacaatccatatgcaatgaactacaggttcatagctgctgacacccttcagaaaatcatagttctttttgttctagctatttggtcaagagttagctcaaggggatcccttgaatggtccattactttgttttcactatccactttaccaaacactttagttatggggattcctttgttaaagggtatgtatggtgatgcctcaggaagcttaatggtccaaattgttgtgcttcaatgtatcatttggtacactttgatgcttttcttgtttgagtatagaggggcaagaatgcttattgcggaacagtttcctgacactggaggttccattatttcctttaaagtggattctgatattatttcattagatggtaaagagccattggaaactcaggctgaagttggtgatgatgggaaacttcatgtaactgttagaaaatccactagttccaggtctgaaatattttcaagaagatcccatggtcctaattctggcctttcattaactcctagaccatcaaacttaactaatgctgagatttattcattgcaatcttcaagaaatccaactcctagaggctcaagctttaaccatactgatttttactcaatggtgaatggaaaaaatgcaaatatgagtccaaggaattccaattttgggaactatggtcatgatgaggagagtggtgttgctggatttgggagaggaaatggggtttatggacagggaaatgcagggtaccctgctcctactaatgctggaatcttctctccagccactggaccagttacaaagaagaaagctaatggtggtacagaaggtggaaaagatcttcacatgtttgtttggagttcaagtgcttcaccagtatctgaaggagggattcatgtctttaggggaggaggtgactatggtaatgagcttggtgttggagcccacccaaaaggtataactacattcttggactatgaaaaatataccatgtaccatgttgtactagttgtttttccatattttaattggttttggttgtcttattgtggattaatactcagttttgtgtttcttgttcttgttacttgtttgttgcaatgcagtttgatcctacttaattggggtgtacattgaccccaacctcagaggtaaagagggtgttttcgattgacccttggctcaactagataggcttttatatttgtgttcgattaatctgtggagggttgaagggttggagtttgctaagtaatttggccttattgagttgttttcattcaatagtttcttgttttaggcgtaagtttggagccttgcatatccagtccctgaaattatggccatattttttttgtctttttcttgagacaaacatgcttgcattacttttgtcttctcatgttgcacaggaaattgattgagtatctattgtaacaccttatttccttcatcatgtctggtaatttttattacaccatgcataaatccaaattagctgggccgactgtatggatcgtttgtattcatgcgtgtttaattttaatattaaaaaaacttacatagatattcccttattattgaatgtttttcctcacattagattatgatgaatttggccgagaagagttcacatttggaaacaaacagaacctgaatggaaatgaccgggaagggccagttgtgcgctcgagctccacaaccgagctccgtcctaagattgctcaagaagagaccaaggcaactgccatgccaccagctagtgtcatgaccaggctcattttgattatggtgtggcgaaaactaatcaggaacccaaatacttactccagcctcattggcctaacttggtccttggtctctttcaagtatgtttacccaaaatttactttagtttatatgcgtggtctacaattagacttgtgactaatgccaaatcttttaggtggaatgttcaaatgccagcgattatagccaaatcaatatcgattctttctgatgctggtctcggaatggcaatgtttagtcttggtatgtctgatataacaattagataatcttcacacgaaatccccttactgcttatgggaaaatcatagtgttttcaactgattttcatcatggaacaacaggtttgttcatggcattgtcgcctagaatcattgcatgtgggaaaacaattgctatcttctcaatgggtgtgagattccttactggtcctgcagttatggctgctgcctccattgcagtcggacttcgaggtgtccttttgcatattgctatcgttcaggtagaggattacttcataacgatacgtaaacacactttttttgccactcatataactgaaaaagttgctttaaactcatttttcaggcagctctacctcagggaattgttccattcgtctttgccaaggaatacggcgtccatcctgatatattgagcacagggtgaggcctcaaaacacatgttttcatcatgaaatgtcaaaaaaaaactataaaatactaaaagttttgaggttcttgttgaatgtaactcaagaatcttacctatcacctataaaatgttgtatgttattttgcacttctaatataatactaaatcatggtttttaattattattgcagggtcatatttggtatgttagttgctcttcctataactttggtctactacattttgctggggctttgaagctgatgatgaagagccagaaccaagtgtaaaggaaaaaaactagagacccttttggcatatggtcttttttgctactaacagaacatgaaattctcagaaaaaaagagacaaaaatgaaaccaaagtggaattgtgaatggtcaattgttgggaacaaccaatagaggagttttagtggaaaattcttttgttgtctctttgtcctctctttacctttttgaacttttgtgctatcctaggcctacatgtcttttgcttcttttcaatgaagaaagtaatgtttattttttttcttctatatatatgtagatgtctaaattgtcttttaggagtaccttttcttttaaagctttcaaaaagctactactacttagtacttactaaccttaattaaacacaatttatgtgtgaaaatgggctacttttttctttctcatggttaatgtcttcttataaaattgaaaagaaaaaaaatattatgcacactttgtaagtgtttggtgtgctcattttgattgcttaatatgttagattggtgtgaaaaagaaccaagtagatgtaaaagcaaatctctagtaattatagttagttggatcaatgaaataatagtaatcaatacaacaaggtttaagaatgttctacaagacgttaaacaaagtcttaggtaaaaaagcaactcgatagaatgacgaaaaatggagatctccttggtaaagagcgttttatccttttagtagatgaatcgagttaatacttaatagaatgaaataataacgatcaagatagagccttctgatattttatcctttgagtagattagtcgagttagttggatgaatgaaataatagggcaaatgaacagtatagaaccttttgatgatttgcccttttgagtagactaatcgatttagttaaatcaataaatttcgaataaatgaaataacagggcaaatgaacaaagatagaaccttttgataaagtagactagttgagttag

SEQ ID NO: 341 - DNA, 2848 bp, Solanum lycopersicum
tcctcactgaaatcatataaaagaagtcattcattgtattacttcattaactaatgttttaaaatggattatttattgtacttcatcaactaatgttttaaaactaaacaaacacaagtgtctatttgttcaactttatataaatttaagtatctatttgtgtatatccaaaattaaaattaaaaagaaatagacgtgaaacgagatcaaattaacaactgcatttacatattatacatgccattgaaaatctatcatcataattcatatattctatatctaataaaacaatataaggatgtaaaatttaaaatctaccatcatatactatatatctaaaaacaattcctggttttccactcgatgttccaagtccatattagagcttcaacttcgcgcattgcagggcccattcgagagtgacgctcccaacatgattttctccatatccagggctcgaacctgagacctttgattaagggtgaaacactcccaccagtgccgcaccacgaccatgttggtatatatatatctaatctaacaatataagaatgaaaatttttaaaatctattttcatatactttatatctaatcaaacaatgtaaggataaaaatacatgcaaatagaccaaaccattcttatatatattagattttgaacaaagcaatatatattttattttatattattttgtgtgtgtgatgaggtgggtggtgaataatgatgcatgttagttgtggcacatgagtagtgagtggtgaccaaatttaacagaaataatgggtaagcaagagaatatatgagcaacgtgaatggtactcatgtaatcacgtccaatcaaaggctactattctttctcttttcctatttatactcacttctctcttcaattttaatcaatttaaaacaaaccttactatcagaggaaagaaaactacgagaaatcgacaagacaataacctaactttattaaaaaaaaaatcgaaaaataacgaaacatgtcgtggcaaacctatgtagatgatcacttgatgtgtgacattgaaggtactggtcaccatctctcttctgcagccatcctcgggttcgatggtagtgtctgggctcagagtcccaatttccctaaggtatggatcttgtatgttttttctcattttttcgatttggatcgatagatctgtcattaatctatcgatcggaaaatatattgatggatcgagactacctcttgacatttgtgtttacgtatgttttcaatattgcttatatgtaatggtaattttgcgttgtctagtttaaagcagaggagataactaacatcatgaaagatttcgatgaacctggacatctagctccaactggtctattccttgcgggtacaaaatacatggtcattcaaggagaacctggtgctgttatccgcgggaaaaaggtattttttcgaggaattcagtatttaaatctgatgaatttgattgcgagtaattttatttttttttgggtgtagggtcctggtggaataactattaagaagactgcacaggcactgatttttggtgtgtatgaggaaccagtgactccaggacagtgcaacatggtggtggagaaaattggtgattaccttgttgatcagggatattaattagtcactaataaaattgattatggcataattgaattttgttgtattttgtgattgcatatgtattttctagggtcaaattggctctggagttttttttttttgtttatgggaaaataaaaagcagcatgagatattttctcttttagggttgctatatatatttcccttttttttttttggttataaagtttacttcaacaatattgtgtattcagcattttgtagacattttattgcaagtctaaaagcaattttttgtctaagatataatggctacaacaaactgaatttcatgtctacgatagaaatgattactatagtgctagtttgaaaggctcgttggaattgattcacgaagggattaatgttatatacacaatgtaagcactaaaaaaaaataggtattggtttggtaatgattggagcagcaaactcgattttcttgtattatacaggatagaacatcagttttcgtaaaataaagataaaaggaacaaaaattttatttttgtaaaaaaaagttatacttaatgcagctaccaagtcttgtgtaaatatgcataaataatattccctccgattaaaaaagaataaccacttttcctttttagtctgtttaaaaaagaatgacctttttctttttttgtaacattttaatttcagttttccacgtgacatgtataaggccacaagatcaaaggataattttgtacatttaacctaactttaatttaggaccacaagatacaaaaatcttctttatattcttaaattcggtgtcaaatcaaaccagctcattctttctgaaaaagagaaagtaacttttaatctagttactcaaaatatcagtttgtttactggcattccaaagtcatgaccataagattcaaattcttaatacatctgtaaccaagccaacaaaatatgatttgattggatctgaacgtcatgattgacaaaaatagatcgtcatgatttgaaaatgtgacgaggagatgcatgaatgacgtagttcggaggtgtaaggattgattactaattaaggaatgatgcagtgccattaggtgctgacaacacattctgctgtccaaagttaggtagacattctgggaataggatttacgataaattgatcacaattttttttgttaaaaggtctgaatgatgaacgatttaatgtatgaaaactagaatcatagaa

SEQ ID NO: 342 - DNA, 7044 bp, Solanum lycopersicum
catattaaaatcatataagttgacatcactaagttcgttggatttgcatgtagacccaattattcagatactcaacatgactcatttaatattggattattgaaatatttgtaatacattaagaatataattgttaactattttaatttttaattatacgtaaatatcaaacaaaaatattaatatgatcgctatattagatgataactataaggagcctacacaattaacactatttaactctattctttgcatttataaaaagttactttagtcttaggttcacaatgtcaaaatctaaacaactaaaaacgacgaggagtaaggtttgcaacgacgataacaaggattaggcaacaattagagttgtgaattgtgagtattaactatacttttactatattaggcagaatttttgcactcaatgagtaacttgatttatttattttttatttcgccctaaattattggacaagtcatatatttgttttgaaaacattcttttattggctaaatcgaaaattgaatcgttaaagatcaaaaatcaataacaaatatcttattggtttaacatatttaaaaataaaaaaccaataaatctaactaataatatttaatacgaaaacgaaatggactgacacacattcctaaatttttggtcaaaattttttcataatttccctaaaatctaaaatattaaatatttgacggaaacaaaaaattcacttttaataaattatttgaaggactaaaacagtggaagaatatatttaagaagctaatttgaacctagtgccaaatataaagggaccatttttgtcatttttcaacttgaaaatctacgtgtcttaatataacaccaaagaattaatatttactgaaaaaatgtaaaaatgaggatatggattctgaatcactcaattccaatcagcaaaaataaaataaaataaaataaaataaaatttaaaaaataataataaatgctataaaatgaccaaaatgtgtggagcaaaaagtgcagaaaaaaccaacaaattgcattctccattcttggaagtggccattcttgatttcttgaaacaaaggtttgtttcccttcacttcttgatatgtaaagttgcaatctttataactttctattgctttgctagtgtttttgttatatacagggggtggagttagagggtaagttacgcatttagtcgtaactttagtcaaacttcgtaataatttagtaagttaaaatatattagaaattttcagaattcataaactttaaattttaaattttgacttcgctttgtgtgactatacaattacagaaattcagagtggccattgttgaaagagagggtggaatttgtgtaagttttgtttcctttcagttcttgatatataaagttgcaatctttaacattctttgttcactttctataggtttgctaggttcggttaaattcagtagctttagtttaaaccctatgcggaatagagaatgtgtaaactttaaacttcaaattttggctccgcatacgactagcgactatataataataggaattgagcacttggcttttgtatatagcttctatgtgtaccaaaattagaaaatcaggcgattattataatcttgttgactaaatatagaatgcatccattacccccaaaaagtgtgattccactgtcataggaggttttttttatttcattttatttgtgctttcaataatgtagagtagttttacaaagatcctttctttgtgacacatggtaggtaatattgctgattttgttgtagttttggggttataaagtttcaaattatttatactggagggtaggggtgggggttgtctataatgcaggttatggttttacgtgaactcaataattattgtagatactaagaaatccactcagtgttcttgcggtgtcttgcttttgatttcagcatcacttgtagttgattgtgtttagattatcacattattctgtggctgtaactgtatccttgttagttgctttgtttctacactgttgttttccctcttttatacctattttgatatgttgtactcgaacgagggtcatcggggaacaacctctttacctccgtgaggtagagctatggtctgtgtccactctaccctccccagatccctcttgtaggatttcactatattgtaatattaacttgaggtcactataggagctcaaaaacttctaattttgaatcaatgtctggttatactttttttgtcataactgtatctcaaatgtggtgtttggtttatctcattttgcagaagtcaagaaacaggttactcctgtttgagtgaggaaaagttggtttgcctgtctgtggtctttttataatctttttctacagaagagaaagtgggtaattttgtttgagagtggaaatattctctagtgggaatctactaggagtaatttattttctataaactaagtaaagtttggaaggtgacaaaaagaaagacaaaaatcttggaattgttttagacaaccaaggttttcttgctcagaatgtctgttgccttgttatgggttgtttctccttgtgacgtctcaaatgggacaagtttcatggaatcagtccgggagggaaaccgtttttttgattcatcgaggcataggaatttggtgtccaatgagagaatcaatagaggtggtggaaagcaaactaataatggacggaaattttctgtacggtctgctattttggctactccatctggagaacggacgatgacatcggaacagatggtctatgatgtggttttgaggcaggcagccttggtgaagaggcaactgagatctaccaatgagttagaagtgaagccggatatacctattccggggaatttgggcttgttgagtgaagcatatgataggtgtggtgaagtatgtgcagagtatgcaaagacgtttaacttaggttagcttcttcaatctattcattcgtttaccaaatattatttggtaagcactaattatgaatatatatatgttcatgttattgatgaagacaaaatttgatctttgtttgtttattcaggaactatgctaatgactcccgagagaagaagggctatctgggcaatatatggtgaggtttctagccatttaataacagttacgcgcacaaacacatatgattaatcggggacgagaaaaaaagaaatgaagtttgagttttgagggtcatatgtaataggtaaatccgagcttgactagcttgagatgtttattgtcatatcatgctcaatactaaccaaaacactgaaaaagaacttgattatatttacatactaatattttcatttgcgttgctgttcacatttttacctatggaactggtttttgtgatttgttatacttcatattcgatgttaataaaatatatcattcctccctttttctccacttcaagctttactgtagtgttgaaaggggaaactccttttaatgattgcatatataaacgaacttcttgagttgaatagtttctcattatgatctgtttaaacagtatggtgcagaagaacagatgaacttgttgatggcccaaacgcatcatatattaccccggcagccttagataggtgggaaaataggctagaagatgttttcaatgggcggccatttgacatgctcgatggtgctttgtccgatacagtttctaactttccagttgatattcaggttagtctaccaattctatggtctttatatttgttcaatttgcgtttgatgtcacttttgctgagggcttttctaatagcttacttcagcctagcggaaatgtttgtagttgaatctctagttctgtctcctatatctgtttctctcgtcctagatactacacatacttcatttctgttttaacattttattcgtcttttggtgttgttttgtatgtgaatcatatatttggaacagaatcattattagttcacatgatttcatttgctttcttcaatagcgtaattgtctaaccttccaatatatgttgcagccattcagagatatgattgaaggaatgcgtatggacttgagaaaatcgagatacaaaaacttcgacgaactatacctttattgttattatgttgctggtacggttgggttgatgagtgttccaattatgggtatcgcccctgaatcaaaggcaacaacagagagcgtatataatgctgctttggctctggggatcgcaaatcaattaactaacatactcagagatgttggagaagagtaagtacaaagctgtgttttacgcacataattttttttgctaatatttacatatcaaaatataggaaaatgagctcttcggttatccggtttatattttttttatgtcaacataatagtataaagtaattagtatcagtcgttctgggaataaaattgcagaactcaatttagccgtgttgtgaaatcctgcttgttttgagagcttaaagctcattagttagtcgttagagacgaagaaattcttcgttgtccatctttattccaccttaaagttgtgatattttcattattggtacatttggcaaaaacacctgaacaaatttatgacggatgccttttgaaagtcactatacctgtctagtcggcgtttatcacatttctttgacatattgaactttgaaacatgatatcagctctagacagtgacgagccatgatcaatttctttcctttattctttctttggaagtgccgtatttaggcttccgttgttcttatatattgctttccctgcagtgccagaagaggaagagtctacttgcctcaagatgaattagcacaggcaggtctatccgatgaagatatatttgctggaagggtgaccgataaatggagaatctttatgaagaaacaaatacatagggcaagaaagttctttgatgaggcagagaaaggcgtgacagaattgagctcagctagtagattccctgtaagcattcgtaaactctttagttttatgaaatgattcttttttcgcgttattagatgaatatggttgcttgtgttgagtatttctaggtcgatgaagttgagacaagggtttttaagttttaacgacttttacggggtgccatgttatctgctacctaatcttaggtagttgaccggaagggctagaattttaacctcatgttcaccctaccaaccaagaaatgaacctcgcatagagctcgtagttatgaatatttgctttggcatgacattgtgcggatcatgaaatgtcttagattatatggaaaaatcattctattacatcgaatagatacattagatctaagaagcacgccgtgttgtaaatgagaaattctatagctcagatctttagttttctctgaacgacctacaaaccaacggataaccttgtattgagcttgtcgttctcagtatttgcactaacattacgtcgtgtggatcctgaaatggcttggattgctattattctggatatggcaaaaccattttattagtactagatatcgaataactacatttgaccctacaagtaccctgggttggagttacaatatcccatacctcgtatctttagtgttctcttatttatcacctttgtctactattctggcaaaataacctcactcgttactcggtgttttccaggtatgggcatctttggtcttgtaccgcaaaatactagatgagattgaagccaatgactacaacaacttcacaaagagagcatatgtgagcaaatcaaagaagttgattgcattacctattgcatatgcaaaatctcttgtgcctcctacaaaaactgcctctcttcaaagataaagcatgaaatgaagatatatatatatatatatatagcaatatacattagaagaaaaaaaggaagaagaaatgttgttgtattgatataaatgtatatcataaatattaggttgtagtaacattcaatataattatctcttgtagttgttgtatcttcactttatctcaactcctttgagagaactttccgtagttatctgctttgcacttggttactcagaattttactgtgggcatgataattgatataccaaattcagttttgattctatcgaaaaatttgttattacatttttttggggggaaaggaattatctcagatatgacgattttacatttcaattttctaaagttgttatccaaattcgattcaatccatacaccaatatccaacaagagagttaagagacacattggtctagccatctatacgcagattattgagtagtattttttaacagtgcaaacataattcggtttttttgtcgattcggtttgtagaagggaaaaatcacaatattttatagttgaatttgtaatctaaattcgagttgtatgatacaagttgcttcgaatcgatcttgatacatatttctacctatcttaatagtcttttcacctttttaaaactttatatcaacaaaattagacatataaattgtaacgcaacatactttattaagtattggtggtttgggccaaaacaaacaagatcatttaaggtatgagcaactctatcttgtatatttatttacggattatgattttattttaagaaaacttaataaaaatattattcaattacttttttttatatatgtatacacacacctgggcatcaaggaggaacgtaacatacaatatttcaatgaaaatactggtcgaatattgtttcatattatcatattgtataaatatcaatagaagatataatattattcagatgtggtatcaaggataaagaagtagtgattcaatgaatagatcaaaaggacaacagtaaaacaaatagtttgggccgtaggctcaatcaaaacaaataaattaagttaagttcaatttgaataaatactttacgtaataaatctaatttatataagttttaaaaaataatctcataaaatatttcgtgattattattcttatccacgaacccaaaaaaaccctaaccaatggatgagtcgatgggggc

SEQ ID NO: 343 - DNA, 5805 bp, Solanum lycopersicum
ttttgattttaattagagtaaaagtatcgtaaagaaacatatcaagatcactataacatacataataataatttaattatgatcttttaagtgtatttatactacaataatgttgattatctctcttttaccatagtactattctaaaataatatgcatgtaccaagattaatgtaatcaataagtacaagttgcgaaaaaataaaatttgtctattaataaacttacatttaatattttggaaccctactattttttagggaaatatgaatatggaaactctaaataattaccctattataacttttggattataatgatctcttatagtaataatagttaaagctacctcatctatctcttatcttgtactcatatttcaagcttttccaagatttgtttacaaaaaacaattaataactttaattacaatcatccaaatcaaaccatatcactttttaagtaattcacttaataaatactcaaccaatcaaaacaccaataacagcatcaacaaccgttacaacatattcagtataattctataactaaatttggtaaaccttaaaatatataaactcataccttaattctaccttgacccaaaaacaacaattacaacatattcagtataatttcacaattaaaataatatattaatatgaaaattaaaaaagaataaaaataatatggtcaacactaaaaatagatggaaatagggtgatccggtgaaatacgtgtctataggagtcttttgacttgcttaataaaaaaaacaatattcaaaaccttcttgatcatgacacgtgtactaaaaatcatcttttggacccaattagacacgtggcaagatcatagtggttcaaatcctataaagaaggttaatagaagaatatacgataaaaagatgcctttttcgaactccctttaaatacggcactaattctccatatttctcttcattaatactttcttttaagagatttcagattcagtgaattaaaaataaaaatgcaaaataatccaaagttttgatttttaattttgggtatttttgttggagttcttgaacgtaaaaaaaagaccaaatcttgaaatttggtttttttttggtggaaattgaagatttactctttaaggttagtgtaaagatctaatcttttttaaaattttgttaattttcttgtgtttttactccatgcatttgtgttttttatggagaagtagtgataaaaatgagttcttgattgtttattatggtggaaatggaggttttgatcaatgggtatctgtttttgttcatacccatatactgatttattataaaaatatgaactttttagcatattgatgattttttcaagatttcattttatatggtttgtttcaggatcaaagaaactgatttccccctctctaaacacccccaaatgaaaaagatttcgttcttattactgtggcttaatagtactttttacgtaacatacacataaatttcatataaaaaattaaaaatttcatatataaattttcgatccaacttaaagagtaaggtttgtttcttctggtgttgaaaatgggaacttgtatggtcctatatgtatagttctgttcggtatacactggttgtgaaaagtactaacctgtcttctagatttatggatcacatgtaaatgttaggctgtttcctttatatttttttgaaaagtcttcacttttttttctaagaaaaaataaataaatactatcttttaatatttatatagctctgcatgacttcatagtatggactatatataagtaaaacaggagtttacttgttttcttttaattattggtctttggtagcaactttaaacctaatatttactaatatcaaccactccatatgttaaaaaaataatatcacttgtttatactttttaagtaaattatgtatctttgtgatgcaatcatgccacaaattttttgaatgaaactgtctctctatttactatttactacaaggtagaggcaaggctgcgttgatgatttcggaattgagttatgattgaacgactaggtccttatcatctttttagactttacttttgagattacgttcggtttgtgatgatatcatcagccagaatctcaaggaatctgtgtatctctatctggaaataactgttgttagtagtaagcactgtatagctgatgtgattttaaaccactttttttctcaattttgactatttaaagctgaggttgtttattgatttcacatatacactatagttttataatactatgtcacaactttaggttaccagctttgaaaagtagcacacatgcttagcatgtgtcatattaaaactaataaaataatagacagaaaacaagactttttgtggccccccttgctttgtctttatcaagaagtcaattttctacccccctacaggacaacttacaaatttattagtattaattattcagataaggtttgattaatgcaattcccaaatatcttcttatttttgtaatgttatttgagtttaacttgtgtgtactgacagtgacaatgtaaagcaatagtaaaaagtgggattagtaaccttgaacaataagtatgttacttgttacaacaggttaaaatatatgttcttgtgaaccaagtatactaatgttataagtgatgtaagttaagtccttataatttacataacctcttgtttgatcagatttgatttatgcaatcctaaactacctttttggtttgttctgttatttgagtttaacttgtgtatactgatagtgtaacgcgggagtagtaaccttgaacactaagtatgttccttgttataacaggctaaattatatattcttgtaaagaatgtttactatgttagtgatgtaagttgaattgttataatttacaccctcttgttctgttttttgcaggaagtttagtcatggcgaacgatttgcaagtgctaaatgcactagatgtcgcgaagacacaactgtatcacttcacagcgattgtgattgctggcatgggtttttttactgatgcttatgaccttttctgcatttctatggtcactaaattgcttggtcgtctttactaccatcatgacggtgcattgaaacctggctctctgccccctaatgtttcagcagctgttaatggagtcgccttctgtggcacccttgctggacagttgttcttcgggtggcttggagataaaatgggaaggaagaaagtctatggaatgacccttatgattatggtcatttgttcaattgcctcggggctttcatttggccatacaccaaaaggtgttatgactacgctttgtttcttcagattctggctaggatttggcattggtggtgattatcccctttctgccaccatcatgtctgagtatgctaacaaaaagacccgtggagcgttcattgctgctgtgtttgctatgcaaggtttcggaattctggctggtggaatggtggcaatcattgtttctgcagcattcaagggcgcattccctgcaccagcatatgaggttgatgctattggttcaacagtccctcaggctgatttcgtgtggcgtataattctcatgtttggtgcaatccctgctggacttacttattactggcgtatgaagatgcctgaaactgcccgttacactgccttggtcgccaagaacttgaaacaggcagctaacgacatgtccaaggtgttgcaagtcgaaattgaagcagagccagagaaagttacagctatttctgaagcaaaaggagccaatgactttggtttgttcactaaggagttcctccgtcgccatggacttcacttgcttggaactgctagcacatggttcttgttggacattgctttctacagtcaaaaccttttccagaaggacattttcagtgcaattggatggattccaccagcacaaaccatgaacgcgttggaagaagtttacaagattgcaagggcacaaacacttattgctctttgtagtactgttcctggttactggttcacagttgcattcatcgataagattggtcgatttgcaattcagttgatgggattcttcttcatgacagtcttcatgtttgccttagccattccataccatcactggactctcaaggatcacagaattggcttcgtggtcatgtactcattcacctttttcttcgccaattttggtccaaacgccacaacattcgtcgtccctgctgagattttcccagccaggcttaggtccacatgccatggaatatcagcagcagcaggtaaagcaggagctatggttggtgcatttggattcttatacgctgctcagcccacggatccaacaaagactgacgccggttaccctcctggcattggtgtgaggaactcgttgatcgtccttggttgtgttaacttcctcggtatgctgttcacattcttggttccagaatccaatgggaagtcattggaagatttgtcgagggaaaacgaaggggaagaggaaactgtagctgaaataagagcaacaagtggaaggacagttcctgtgtgagttttagacaagttatcagttagtatacactacaatgcagtttgagttaatttgtggtatttgggattagaaagagattgtttgttggtttgttataagaagatggaataagctcttatctttttgtttgtttgtttgggtaattaaacattattaccttacttctgcaaatctcagaaattctgagattatataaagtaaccaaaggaggttctttggttgtctatctctttttataaaacatttcttgactctattttttatgtgtaaacaacttgtttttttttaatcttccctttttatgtataaacaacgtgtaatcagagatttcgagttcgagtttctggatatagaatcatcaatgttatgaaacactttatacctctaatgtgaggttattttggtgtgagtttaaatttagtcaggcttgggggtaccggacatgttaagcatatcaatagctataatatgatcccaacattgatggtggtagaaggggtaaaatttattcgcaatggatgtatacatcaattcttcacataccaacagaacctcctcaaactacaactgacacagaagctcaacctactagttttataatacacggctcaaaaggctcaatgttcatagttcaatcacacgaaacaacaaaacaaatcaagtaaatccatctcaatatcaagaagattaatcacacgaaacaaatacatcaatcacaagtagcaagtaagccacacattaacatagaaatacatcaaatcacaataatcaatttcttaccatcattttccattggcacaatatcactaggcaaaatcattttccatcgactttatatcaaatcactagtcggaatcatttttcattggtcttatataataatactagccggatttgacctcggcataatagcaatcatcggagagtcctcgacattataataatcgccggtgaagacctcgacatcataacactcaccgataaagacctcgacatcataacgctcattggcaaagacctcaacattataacactcctcgacaatgatctcgacatcaagactatatcatgtctcatcacaatgtttgacaaacgatgcacacaagcaatatcacaacatatgaaagagacaacaattcatgcaattcaagaagtccactttcatgctattaatcatttcatcaatcaataagggttacaacaaggtaattcacaaacattatgatcacctcaa

SEQ ID NO: 344 - DNA, 3811 bp, Solanum lycopersicum
tacggatttaatacttgtataactcatctccaaatgatcagctaccacgtttagacattttcacatgatgttgaggcatatattaggctaaatttcacatcaagttgaggtgaataatttttttcgaatccgaataattaaaacacacaatttaatacctaaatctacctccaataaacttatatttgaaacataaatttcacatatcaaaatgaacttgcaacaatggtgactttcgttgttgtcaacccatttgttttcaaacttttcgaccatgcaaatgctaattataatatctatataaattttatttaactaccaaaattgcttcaagcctctgactttttttattgaactataaaatatttttcaagaaagagattgataattggagataatataattaagacatcatttcaattcatttttatttttttaggtaatcattaatcagagaagtaaactatgtcttgttgctaattataattactcaaggtcgtggtgtaaaagaaatggagatatacatcaacaatcttaccacaactttcaaatggtaattatggagcctcacaccgttgcacaatccttacctctagaacgaacgttaggtttcaatcaatcctaactttttcattcagtaactttaataaaatgatttatagttacatacacattaagtaacgattgtgttgtgttctacaaatataatatcaaagctataagaagactttatgttaaaataaagataatgatatccattatttcagaagattaacaacttgccagcatattgaagacaagttcaaagacataacgagatatatgctaatacttaatcaaattgtagtaaaaaaattgtaaatttagtataagctcgacatgatataaaggtatatacccataatattcttgagattattctttttatattagtgtaacaacccttataagtagttgcgattttcccaaatgtcaaacacaccaattctcacaaaaatcaagaaagtgcacaattttttgaaccaattttaggcattatggctgtgggggataatgataataataatttacaagtgcttaatgcacttgatttggctaaaactcaactttaccattttacagctattgttattgctggaatgggattttttactgatgcttatgatctgtttagtatttctcttgtcactaaattgcttgggcgtttatactataccaaaccggatcttttgaaacccggaacactccctccggccgtatcagcctcggtcacgggtgttgcccttgttggcaccctagccggccagctattctttggctggctaggtgacaaaatgggacgaaaaaaggtgtatggtatgactttagttctcatggttgtgtgttctgttgcttcagggctctcctttggtagtacacctaagggtgttatgactacattgtgtttttttaggttttggcttggatttggtattggtggtgattaccctttgtccgctaccatcatgtctgaatacgctaacaaaaagacacgtggtgcattcatagcggcggtattcgctatgcaaggttttggaattttgtttagtgggatagttgcacttatcacagcagctggattcgatcacgcgtatagatccccaactttcgaggaaaatgctgctctatctactgtaccacaatcggactacatttggcgtatcattctcatgtttggatcattgccagctgccctcacttactactggcgcatgaaaatgcccgaaacagcacgttacacggctctagtcgcgaaagacgcgaagagagccgcgcaggacatgggtaaggtactacaggtggaaattgaaagcgaggaagccaaaatcgaacaaatttcaaggaatgaaactaatcaattcggtctgttttcgtgggaatttgttcgacggcacggattgcatttattcggaacgtgttccacgtggtttttattagatattgctttctacagtcagaatttgtttcagaaggatgtgttctccgccgtcggatggatccctaaagctccaacaatgaacgctgttcaggaagtttacaaaattgcgagagcgcaaacattaattgcgctctgtagcacggtgccagggtactggttcaccgtggcgtttattgacattattggaaggttcgctatccaattgatgggattcttcttcatgacagtgtttatgtttgcgattgccatcccttaccatcattggacactggaggctaaccgcattggattcattgtaatgtattcgcttacatttttctttgcgaattttgggcctaacgctactacatttgtggtcccggcggagattttcccagcgaggcttcgatcaacatgtcatggaatttcagcggctgcaggtaaggctggagctatagtgggagcgtatgggttcttatacgctgcacaaagtaaagatccaaacaaaacagatgcaggatacccagcgggaattggaataaaaaactcgctaattgttctaggctgtatcaatgcacttggaatgttatgtacattttgtgtgccagagccaaaaggaaaatctctagaggaagcatcacaagaaactataactggagaagcatgagatcattaaatgattggaaaatcacttttttttttaatgtttttgttggtttaatttcagttttctttgtattgtgtaagcttgtttgttgcaagtttttattgtattatttttttgtggccaagtgtgttattgtaaaatggttttgctatttatttatattataaataaaaaaattgtttgtaaattgtgtgatatgacctgacctttcatttttttattttatttttactagcgtgattcacatgtatataagatattagatacataggagagtgacgagcaagatgggatggatgtgagggagtgtatctagaacaaattacactccattttaatatcattatgtctctcgagatatatttatttggatgcatcaaaatacgataaaaattttaatattattataaactaaaatatatctaattagtttctaaactaatgaaatttctataaatttttcgaaatattactctacacaatttattacttcataaagcgtcagcccacatgatatacgatgatccattaatacacgagatttgggcttggaccaagtttaagaaacacaggcccgtcactttttcttaaggtgaaatcccttcaatttatttatgggcctaataacttggatcaaaaataattaatttagatttatgtcatatagttccactaaggtgtgaaccacattttcttggccgtggccagccttctttgtaatattatctagaattcagaatttatttttccgactaatttaaatttgtatctgatagatccattaattaagaataaaacacttcttactaagaaatatcttatttctaaggcttaaaaattaaaatcaaaattgatatttttagttaagaataaaaggttcatgttatagataatcatctaattaacagtaattgaaaagtttaaactcaaattatttttatataagttttttattcgtatttgacagattaaagaataaagtggatcaaatgaaattggatcaaggaaatagtatatacttacgaccaaaaggtgtgatagaatgatatatgttaatttatatacccttatatagaaatattgagtttaagatccaagaataaagtggactttcttaaaaatgcttagatcaccatagttgacttttaactttattactagattagtcgaatcaataaattttttaa

SEQ ID NO: 345 - DNA, 3906 bp, Solanum lycopersicum
ggtttaaaagtttaatttcataaagtttaagcgttcatttcacaaaatcatgattagaatagtctggttgacaactctttaatcataatttttcacattacatgtttatataaagactacaagataattcctatattctatatacatatctttagttttagaccataaaattttaaagtccattttacttttttaaacttcacgtcaaatcaaaattaaatgaacaaattaacatacacgactactatacatggtactaataatgcaaagcctttgttatcgttagaggaggagtcaaaatttaaactttatgagttctgaattctaggatatataacgacatcctacaaatgagttctaaatttaaacttttttaaatatatttaatgaagtcttcataatacaattatataatcatctgaacagaaaatattaaattcgactgaactcataccatctagccccccaaacaccactatctaagcaaaactataaataactttaactcatgctaacctatatttgtatagccaaaaaaaagtaagtaggagtaatattttatgatgtattaaatgttgattctgtagtggtattttattttagtcaagagagggggcctggtgtgtactgttaaaatggaaaacaaaagcaagaagtgactcatcagagagtaatttgtactaaggtactatcagagggtgtccaaaatccaagaagcttatgtaatgttactttcaagtatgcaaaaaagagataaaaatatgaagcaggtaaaaataaagtcatattctctctctctctattatgagtgtagtgtatttgggttctgactgatataatgggtcatgcatgcatgggtcaatcacttccttccaaatatttccaactttatttatcatttgatttccattcttattccctattactagtcatttcaagtaaccctaattacttaacactttccctatatataaagaactatttagctattacttcttctacataataagacatggagacaaaaagtactgaaaattgtaaagatgaggagcaaaaaaatcactactactactctaattctacatcaccaggactattaagctctcttgaagatgaagaaattaagaggaaaatatgttgtcactctttgtatggtcttttggttcaaactcacttggattgtttgaaggtattttcctcaattacactcatcaacaaattagggttccttaatttttaggttactcaattagtaaagtaaagtcgtgtagtgtctttccgagataatatctgttagttgaataagaagttcgatattgattaattacttaattagcaggtttgtttggggattactgagattgacaaaattgatcaaaaaaccgaagaaaagtcagcaaaatgtaacaaagttatctcacacacaatggatcatcaaacagaattgaacaataagttcagctcactcacaatggatcaaccagctgaactggacaacttcatggtactaataagttttatctcttcttttttgctttataattccattttatggacagtagtagcagaaacaggattttcattagttcaactatctatacatacaaataaattgactttgtatacgtagtgtgatttttagaggtctagacacaactagaaacaattgttttcccttccacgaatcaatgaaaaacttgtgttgtataaacatgtttttcccatgacctaattgtgtttaaaattagtatatatatactaggtttaaggtatatatgtagctttaatttttgtgtaaaaagctaattcaaatggtgtggacaggaagcatattgtgtggctctaagcaagctcaaagaggcaatggaggaacctcatttggagtccataaagttcatcaatcatatgtattctcagctcagtgaactcatggaacttcctacttctacttccactccatctaattttggtaacattaattactgccattttcattttttttaaaaccaaatttagcacacacttcatgatagtaattcatattactagctgttgtaaatgaagaggaacggattttgatgtaataatcgcatacctagatgtacgcgttataaatgacaaaatcaaccggtaaggttctcaatttgtgcgatggaacataattttttcatccaatcaaatcactagaaaaaacaaattatcagtgaattaaatagtacaagtcaaacttccttttttttttccatatgaaaccattattatgttttctcaccgatttaatacaaaatattcatatgaaaatagcctctagttattttttcagtcaaaaaatagtaatattaaattgttaattcttgtaacttaattacatcatgttaactaagtaaattattttcaaaaaaaaaaattatttccataagtactcagtcaaaataagaaattctgactctcgaaattcaaataatatcatatccatatgaaggctaataagatagttataaaagttcacaacttgatatttgttcttttaagaaacaagaaactaaagtatctagcaattggttcttgttttttttttgtttttttgtagatgggatgaaggcccatggcaacaaatgaattggtggcatgaggaagctagatgattgatagagccaagattctataagctcatatataatttatctaattatttattactaattaagttacttcatctatatatgtttagcgatctatgtatggctagattgccacaactcgtatgtttttttttctttctatgtagcataataatgttaataataatgaggaatcccaacagctggtcgaactcataattaagggtttgagatgttaattctgatatgattataagataaattatgaaagaaaggcttgttgatgaatacaactccacctattaattaattatatatatatatatatatatatattacgttcgttataacgagtctctataatttcacgaatgaaattaattgaagatgttagtgtgacatttaatattacattgcataatatattaagtcatgtctcatgcatgacactcactgctgcatttgctctaatatattatgtgaatattgacattttatgcctcgttactcgagatattgtagaaatggcataaaactaaagatacttaaatttataaaagactactctatagatattgttaattgactatagatgtatcattctaaagcaaccaagtgaatacagaactgcttgagtagtcgatcgatcgataaatagttcatattagacatttaatagtatctaatggcaatagtaaaatgaatacaaacagatgaataattcattggttttgctacacagacacttttgtttttttgctatgatcaggatagttttgagtattggatcatatcatatcctaatatagaaacctaagtcaacttaaacagttgaatgggtcacaagtcaaaatccacactttgtaacaatcaacttgcataagttgaacaataaaatgagtgtcgatttttttttatcataattttgttcaaagatggaaaggacacttttctcgggacggattcaacaattgattgcttgtgtgttcacgacaatttaacaatatttgctcaataatattaaaatatttatcgaatatttatgaaatattaaactatgaactcaattattttcatagagattgacattctggaacatgtaatgagataagatgtagatgatgagtccaatcagataagtgatcataattgattaggtgtggttagtctatataggtagcacaaaacctttttttttcttcagtcttgtcggattatgtcacctatccttaatgaccttcctttcatctattgtttctcttttgccttcttaccaataaataat

SEQ ID NO: 346 - DNA, 7268 bp, Solanum lycopersicum
gtctagttagttacaaataatatctttacacgatcttaaacaattctcattttatgaaataattttttagcgtaatttagataagtgttattttcttatcaaatcaagaagctaacctaaagagtatctaaaaattatatttacatcaaacaaatatgattttatatgactagaaggagcacacatcaaatatatgattttatatgactatcttaacattattaatttcagataaattattttagacaactaggaaatttgtaaacaattataaatttagttatgctcttagcttgaataatgacccacccacatgcctaataaaacatcccacttattgatttgcgtggttctaattatacgcctaaactttcaacattaattattaatcaattttttgttcttcctaatttatccttgcccttttgaaggttgtggcttaaactttaaaaaactcaaattttcattaatttaaatacaatatttacattaaacaagcaaagccaaggtcaatttattatatatttatttttattaaattacttaaatataataaattctttatgattgataatattcttatatggcatacttttcctttttaaggtaataatattattatcaataattgtggagtttatattgaccactcaaatttgtcactttaattaactttccaaaagttttggaccaaaaaaaaaaaaaaaactttcctcatacttcaattccttttttttcttcaaaagtattatatattaacaaagttaatattaattgataaaatattttttcatttttaattaacgattttcattcaaaatattaatatgtaattatttttatttttttatatatcagacaagctgtcacgaacttaaattttaaaatataaaattaaatcatagaacctaaaagggtagtttcgtcatttcctttttatgaatttgctatttcgagctgttcctagaatatagacaaagagtcctcaccccatttctccgccttcaagaatttatttttttcttcttcaaaattgaatcttttcagtgaacttttactatttggtcaatcaagaagtgaaattacagagcaaaagcagatatagttttgaagatggcaggttacagaggtgatgatgagtatgattaccttttcaagcttgtgttgataggtgattcaggtgtgggtaaatctaatctgctttccaggttcaccaaaaatgaattcaatttggagtctaaatcaactattggggttgaatttgcaaccaaaagtcttaatattgatggtaaagttattaaagctcagatttgggatactgctggtcaagaaaggtaaaggttaaatctttgaacttttttttgttttgtattggtgatattcactcagtatgttagtttttgtgtttctatatctggggttttcttgtttttggtttatggcttgagttttagtgttttttgttgattggttgcatagttttggtgtaacagtctttttactagtgattgagtctgcatctgtttattttgaagttgtgtgggtttgaagagtagtgttaatggtaataacaacatactgagtgtagtcctacaagtgggggtctcgggagggtagtgtatatgcaactttacgccccctcccccccaaccttgcgaaggtagggactaggaaagcgggttccgaaggaccattggctcaagtaaacgtatgtaagggtagtattaagtattaagtagttatatttatgtgtttgggatttaggcaagtgagaattgcttgtttatggtttgtggcttgagttttagtgtttttgttgattaattgcatattcttagtggaacttgctgtaacactgcttgagcttgcatctcttgattggttgcttatttaagagtggtattaacagtaacaacaacatactgattgtaatcccgcaagtggggtctatagagggtagtgtgtatgcagccttaatcccctaccttgtgaaggtagagaggcagtttctgaaggatccttggctcaactaaccacatataagagtagtattaagtggttgttttttgtgtgtttgggatttagatgagtgagaagtgcttgtgggtttgttggtttaatcttatttttggtaaggttcttcaaatgatgttgtgtttattggtattttctaagagtgtctagatgtgctgttgttgcttgattgggatttcttgtctttgggtgtggtatctgtgttcctaattgaaattcgagggacatggagtgcttactgcaaccaattatatataaaaaaaaaagaagaatatttttccgtgtttggttcatgaaaaagaatatcgtgagagcattttgaagacgtaatgaagtaaatcaaagtgtgttgccccaatggacttttagatgagatgatcatacaattcaacatttgtgcaggctatgtgtgctcctagttgtttagatgctattgtgatgtcaatctgaaagctaattatagaaattgtagtatccaaatttgttgttttaaaattatttgaacttattcagttcccgcacgagtacattggcaggtatgttttttctaatatgaaaaataattgaccaaagtaactcaatatttcctcataatttttgaaatccttagctattttattgtttgactggtttctagctttttttcttttgggtgtaaccatctgatatctgatactcataccacgactagtttagattcgtgttgcataggaccattaaatggggaaacactcacatccacttagttaaaggtatggtatcccatccacttcaccgcacctttgatgttagactttttactgtgatttcatagcttttgttttaccaatctaggaaatcaaagaagacaacttggtgttatatgtgaaaaaggaattgataattttttacaggcatggttgatgtgtagactagaatggaatgtttttcgctagcaaatgcttcctctgaataggaaatagttttactgaactgaccaatgtaaaatatactccatttctagatgagaccattactctttgcggaataagatagtttttctgtttggttgtaattcttgcagatacttgtaaaaaatatgaattaattgtattttcttatgtagtttctacatttatagcatatgattttgattagtttttttttatgtcattgaattttggttttgtagtagatgctatacttaaagaacatacttccttgtttaatgtatgaaaattggaaggaatatccttagtcaacagtctgtcctacacttgatattgttattctaccggatagtatgagtttctcctttttgatttcattgagtagatttgtgatgattataagacatataaaacatgttaataaaaaggagtagagaagtatatgcgaaaattcaaactacaaacttagttccaaactaaactgtcattttgaaatatagatgttttacatggattcttcattaatcattatcatcaatatacgtgtttgagtgattgtgatgtgggcatggttacttcatgtagatacactcaaaattagcgaaaagtctataagtacacatactagatacgtatgcacatcataggaataataaatctttggattagttaggcataaactaaaccaagatgcccccaaggcctagctcgagtggcaaaaggtggaggatttgtgacttaggtcgcaggttcaagcccacaccatgcaaagcgaagcctggtatttaagtggggaagggtagaggggtggacccattatccaccgagtttagaaggttgtgattggtccaaagggcagtgggtcacggataaataaataattggaagtcatatttgtatgtgatacaacttaaagtactgacaaaaagaattgagatacaacttaaggtaacattcgaacttctgtaggattttttagtaaaggtggttttcaggccattttgagccacctgttacgttctaaatccaccagtatagttatccggtaactgtctatcaaagcttagacaaatgggaagatgtcaccctacattttttgcctatgctaggacttgatcccagaaatcccatggttttaatctatttcattgacactaccctggctttttataacttctattgtagtatgttaagaggagtatagtagatatttggtatgggcaaaaaagaatctcagattaattatttctccaaaaagtagtgaacgtgaaagaatttggtgaaccaaaaaaagtgaggatttcagtgtagggagaaatttggggaactaaaagaactgacgatatgggttacattattggttactaggcttatgaatcataagtgtcgatcaaatgccacgagcaatggcatcgtgtcacggttgtccttgaaatgttctatactcatgttacttgcaacaaataataatttttgggtggaaacacagtgcagttttaatgatggggtgattgaaacatgtgtagctggcatgataaaaacgtgaggattgaataaagaggaacataacagctgtccctgcttgaacacccttgcatatctttctgatatgatgctcaagtttgtaagtggcctttatcctattcatttcttgagaatatgtgaagctatgcgtattggttctgccagtgtttctgttggcacagttcagcctctggttcaccaccttttagtttgtaaataacatcttgtacgcttctcaatgtcaaggacgtgatccactctggacgaaatattaatcttccttcttattacaaatccatcattctgttgtatctcctattgttgtttgcatgcaaaacccttttctgagatgaattacattggcaaataagaggtaatcgctgagcattctcatctcttgtgaggagaaaaaaattattttcttctctaactattccactcaaggtgcttttttatgtctactatatttatccacagtaacccagtttcctacttagagcttaaagatagcaacaaaagaaagatggagtagccctcatccttctgggcatttttttggtcttatggtttcttgtcctattgtttttttccaattctcctataggccctgctatgcgtgactccagatttgttgggctccaatgcgggtatcaaaacactgggcaggaaaccaaagaaaatagaattaaagaaagttaactttgtgaataaattgggtcacgtattactggtaaactacagtgttcattatttttcttaaatcagtaaatttaatattcattatattcaaactcagttgcatctacagatttttcgtttactactagtttttgtttgttttcttccctcttggtgttgcctccctccctcctcccccaacattattgacgatctgtgctgatggagaatggtgttatatgcaacttattgttactgttgtatagaaagggaatgtattgggatgcatccttgttcctttaagttgttgtactattgcttcagtttttcttcttcataccaggtatcgtgccattacgagtgcttattatcggggagctgtcggtgctttgctcgtatatgatgttactcgacatgttacctttgaaaacgtcaacaggtggttgaaggaattgagagaccatactgaccctaacattgtagtcatgctcctaggcaacaaatcagatctccgacatctcgtggctgtttcaactgaagaggctaaatctttggcagagagggaagccctatacttcatggaaacttctgcattagaagcgaccaacgttgaaaatgcgtttactgaagctctcacgcagatataccggatcgtcagtaagaaagcagtcgaggcaggggacgaaggtgctacttcaaccgcaccacctaaaggacagacgattaatatcaaagatgaaggatctgcttggaaaaagtttgggtgctgttcgagctagggctcacgtaagacaatagctcaagctttatatatcagttgtaaattgtcattaaatcaatgatttcctctccctgttttctctcactttgggtatcgcgattgtgggatataagatttattctatagtcatgagaatacgtgaagcagcgcgttctcatgaaaaattccgaaggaggatcaggtactgctagtttctaattacagaatgtctaaacaaggtcttagttttatgttttctggttgatggcttgaaaaactggagatatctttgcaataacctgttaccgaatatcttcttatttgtctcgaatttacgtcttaattatttttccccttctaaaagtgtatttcctgagctgagtagcaatgtttgttgttcatgatatgtgtagtttgataaattaaagtagaacatggcaaggtgtgcccagagttgatttaagtggatgatttctgttatatatctcaatctttcgtcgatagaattattcggtagctgtgtttgtgttagtggaagtagcttatgtttggtggtcgatatagttactcgtagttgtgttagtagaagataggttacgtattgaggtgcgtataaattggtgaaataattgaggtgtaatcaagtttatctaaatagtataaaatatgtcacatttcatttagctgattcgtcctggtaagtcgtaaaatctcaaatattttcttacttgatattgatgtgtattttcatttttttaaaattgatattcggaacacttctattaagaattgaagcgtctacttaaaccacatagcattcattcaaaaaataaaagattgtgatagaaataaataaaaggttgtgatagaaattatagccgcaattatgtgttacacatgtttgtcatatgttgaatatagtttttttttttttttaaaaaaagtatttgtttttatcaaacagaaaaaaatgaaaatagtccaataagtcaaaaaaaagggaaccaaataagccgccaggcaccaaatatctttgtaaagcaataagtaggcctccaaaatgtgaatagagattagagagtgatcttagctttttttattatgatttgataattttgactaaaataacgaaaattttaaatttataatcttcaaatttagactatatttttattgtaaaaattacaaaagcagctcaatggcttcaagtaaaaatcaaatcaaagtatatttctttttttttttaatctaccagatctttacataaaaataaaattaaaaaaaagggtcacgaagaacgtggaaccaaaagtcaggaagataattaaaaaataaaaatatgg

SEQ ID NO: 347 - DNA, 5177 bp, Solanum lycopersicum
gtctttatatatacagatggagactgaaatagtacaaaacgccatgtgtccacctctgtctccaaaccagaaatgcttcaaattcgatcaacactgactactaatactcggaatcataaaatattaattaaaattttaatattttaactctaaaaaaatcgtaacaattaaaatgaaggaaggaaataattcatttagcaaaacttaataggggcaaaatgcgtacacgtaattaacgcttctaagaagttccaaattgtctgctgacatcccaattcttagaagggagaaaggcttgtaccaaattaccaatatatcctttataatttttttaaatttcattaattattatcatcatgttgtaagatagaattgttattgtcatttttgtatcttctttatactagtattcaaataattaaaagaaacaaaataaacattattctaattacgttttgtatattaaatattgttaaatttttatcaaaatattttgataacttaacgacacgataaaaggtgcgtatcaatgggataccattgattcatgttgtaatgttaatagttgatttttgaattgtgatttcgaattcaaattaattaaacagtattattattaaacataacatcatgtaatatcatttaagttgatattataaatttcttttcattggtctaatgatcgtacactttattttaaaagaattagtatttaactctattaatgaaaaaagtcgtctcataattctataaatttacatgagtttaaaagttataaaaatagtaaatcaaaattaaaataaaatcgttcatataaataaaaatagtaatcaactctataaattcacaaatttatgagtcaacgaagggtaaaaaggggctaaatttagtgatttgttgattgccagtctgtttgacacgtggcacgcacccatataattgccacgtcacgccagtttaggcttctttaaaatgaaaattaattgagactgtttttgccaaatcattatttcatcattttgtctctcttaactttctcttctccttttctccggcgaccttttttttactccggtcagctatccgccggaaaatcgtaatctattggtgtattcatagcttccttgattgtaccttctcttcaccgatctcaaactttatattagtcatcatgaatccagaatagtaagttgttcattttttacatctaatttgttgtctttggattcgaatttcgaatagtatctgctgtttttttgtttataaattagtttttttgataaccctttatagatctgtttcaattttgcccctgaaaaagaaaaaagagtcaaaagtttccatctttgttgggttttgttgtttctgtatggttgtctgtatagaggttgagggaaatttctagatcgtatcacatatttattgatcgattttaccgtatttgcgttgacccttttttgtcttgcgattataatttgtgaacttggtaaattcctagcatcatgtgttcagaattttttgatatgctttacttgagccgagggtctatggaaacagtctctttaggattacacggggtttgttgttgatgtgtttagaaatttagatggactgctgaaactatatttggaaaacttgtgaaagatcaagtttttatccctaaataagcattagttatagtcacatatatggtgattaatctttttaagctttattttaatgagatcagctagtaatgtggttaactattagctattatacaaatttgggaactgaattatgaaggaaggagagtttcatttactgggcaagttgtctgtgtgccgaactaatagtattcatgatatgtgtttagagaacttttacgcgtaattgtggttatttaatatgtaaggtgtgttctcttccttgtatagtcatatgctaaaagttggctgcactttggagagagttgatatatagcttctatgataaaagtttgatcttggttacatgactgtatggcgctgatgtcaagttattaaatccatgttctgtactttctaattgaactatctaaattcattggttattgctttctgcattttcccagttttatgtgctaaaacttgtagaaaaattgtagaggaggaacttctatttaaatatttgggactcaatgaacatatgttatttttctagatgcgaactggataggtcagtcaatgttaaggtgctctgtatccttgactgaagttcaatattgtgctatatcaatctaactgtttttcgggatgttttatgaacttctgtagctcaactgacattataatcttacttgcagcgactatctgttcaagcttttgcttattggagattctggtgttggtaaatcgtgtcttctcttgagatttgctgtaagttattattgaatttatctgaccattctgcttgcatacacccgaagatttttttttccttttgtgccgtatgtattagtttcttgtttgtggagtttgtttccccggatatgcaaagtatttctcttttgcattgtgattttttgcggaagtatcccttttcctgctggttatctcctcttgcgctcccctccccccctccctccttaaaaaaaatgtgcaaacagatgcttgtgtctctgtctatgtgtaattttctgttctctttttggttggtagaagttcaatttatgcagggtggaactggtgaaagcttctggtaaactaatctttgattcccaatctgaatgtcatatgtgtagttcatttgccttttaaaactgccccgttattatattgtgaagattgaccttcttttggaaggaaattgcttttcttagtgttacttcttttctttttcaggatgattcatatcttgagagttacatcagcaccatcggtgtggactttgtaagagaaacttcatgttctttgtaatgtctcatttaatagttcagcgggatattagtaacaattgtcttcttttttcttatagaaaatccgcacagttgatcaggatgggaaaaccattaaacttcaaattgtaagtatctattttgacttggccattcatgataagtttgcgtgcattttggttgctcactatactcttcctttgagtggctaatatctttctgatgcattgtcttctcccttgtgtatgcagtgggatactgctggtcaagaacgttttaggacaattaccagcagttactatcgtggtgcacatggcataattgtaagttttgtttttcctcgcatgttgtattccgacattgtactatcctctttgtcccgaggttcttactgtgatggcatctttgtcaggtggtttatgatgtaaccgatcaagagagcttcaataatgtcaagcaatggttgagtgagatagatcgatatgcaagtgataatgtgaacaaacttcttgttggaaacaagtgcgatctcacagctcagaaggtggtttccacagagactgctcaggtaatgaatcccctaccctccattttaaaactccatgatgtaaataaaccctgtcattagtgtattgtttcccggtaaatttagacttagttacttgaatagtttgttcaacgatcccttttatctcgttgagctgtatatcccaattgatggacaaccatttttgtaggcttttgctgatgagatcggcatccctttcatggaaactagtgcaaaaaatgccaccaacgtagagcaggctttcatggctatggctgcttcaatcaagaacaggtttgggaattttcacttgacgttactttcgccatagttacagtttgctattttctcgaatggaaacttaatgtctctatgcatttgtagaatggcaagccaaccggcatcaaacaatgcacgacctccaaccgtgcagatccgaggacaacctgtcaaccaaaagagcggttgctgctcatcttgaaaggacgaagctcgatgatgattctgatgtggaatgtaaaattagtctctcttgatggcttgataggaagactcttcactgttattactttctttcaactctttatcgacactcaattcttttcaatctatttggattaacaatatgtagaaaatctaggaatattggtgaatactagtatttgctttctattctttggaccttcatcaaaatgattttatctgcaattgtgctatctttagttattacagtgttacttatgctttttcatatgttgattttcctcctcctgaatctcataataagccatatatgttttgattatcaacatcaaccgaattgaaaataattcaaggattacttaatacctccaaccaaatacaggaaaaaactgtcggagtatcttgcaaaaaagcttagtcacaaaatatatacaaggaactcttgcaaaattatgttagaataacaatcattctttttctcctgtatcgaatatagaatgaaactttccctataataaatgtttagtcactcttaaaaatagtttaccagtaatcaccacaagaacaagttccatttttgaaatggtgaaacctagttgtatctctaacaatgatttccctagtttctattgctgatataactttagtggcttggtggcaatcaccacaaattctgaggttcttgaatatcctaattggcatttctggtggcaatttcattaaaccaaaggcaatggctaacttctcactgtgccacagaagtagctgctctttctgttcctctcctacgtcgtgtaatgaagagtcgagatcaggtacataacctgctaacttcattttcttctcgagatcttttagtttcatgcgtatgctttcgagatctggatgaagtctatcccctgatctgaactcatgaaccactctcccaacctccatccaactgtatcctggtgatttgataactttgttttctttcattgattttcgaactttagaaacgccttcccattggttcttggctgcataaacattagcaagttgaacatagcctgctgcatttgtaggttcaaggccaagcaagttcttggcagcaaactctgccacttctaagtttctgtggatcctacaagaacccaaaagtgatccaaatagtgctatatggggtttgaattgcatctttcttatcaaatccacagcttcatttagctttccagctcgtccaagtagatcgac

SEQ ID NO: 348 - DNA, 11926 bp, Solanum lycopersicum; identical to SEQ ID NO: 259

SEQ ID NO: 349 - DNA, 3444 bp, Solanum lycopersicum
tgatagactaacttgttagataaagttgacaatattttttttaaaaaaaattaaaacaaaaattataattcaccgcaaacacggcgttatcaccgctaactttatttcataattatcaatcaactaaatggacttttcttgtgcattggtcccatttttacgccctaatattcgcttacttgcttttttgtattttatttattttagttttaattttatctacctccaaattgatagaaataattacacttatagtccttttgaaaaattataattatagcattcaagtaaataaaaatacgtatttttagtcactttgtaatgtataattttgagttgaaaatgtatcaaaagtaaatttatattcttaagatatggataaagtttacatatacattatccgtttcataccctatttatagtattacattgcataagttattgtagatcttgatcgaaagtatgtgatattaatactatttttagaattatgttattctcagttatggagtgatatttaaaatcaatatagtatatcgataatcagatagtttaattcttattttctccatccaatttatataatgatattataatcaattttacgaatgagatggatattttgaaatttttagtttaaaataaattttaaattttttgtgggtctataaattatctaattaagaggtaaaatagaaagtttgaaattaattattacttactaaatatataaatatgtcattttttcttaaactgatttagaagaaaagagtgtcatatacatggacagaacgaatataatttgataattaaatttgtaaagattcatagttaatagggatcaaaattgcacgtatccattactataaggtcatatttgcttcataaaaatcatcaggatcaaaaatcagaatttatattatatttgagggactaaaaatgctaatatcacaaattaaaattagtctataaatattcacactttactcttctaattccatcaaatatttccatttatcttctcttcttcttaaatattttattttccttcaaactatatagtaatttcactttccatttgaagagaagaaaaatggcaaagagtggttacaatgctagcttcttgttacttatctcaatgttcttgattttgctcactttctctaacgtggtcgaggtaaatacgtttaacatttgacgtataaatgtaatttcgaatttatatgcaccttatttttctatacaatatgattaactgattactcttcgatctatgtgactacaccattaatctcaattaattattacataaaaatataatgtacctttttttttttggaatttatgtgtctttttcttcatttttacagggttacaacaagctccgcccaacaggtatatatatatatatttactctcatttttaaaattttatcatttttcttaatttttaatgtatgagaaatttttgtgtagtgtatatgtttcgatatatatgagttagtttaactagtttacaagtatttttcttagaaaaatatgataagtttatttaacattataatttaaaagtcaacttaagtttgtcctttttcttgtgaaaatacttctaaatttttatttttcaaatataatttttaaggataacattttagtcattttaataaataataataataaaatcgttacaccggcttattatttatttcaactttcaaacacaaaatgtttatcaactatttttagttataaaaaaataacaagaatcttgtgtttttgaccttttttacctagggatgaacgataattcaatctactaaaatatctatcacttatttttatttttattttgttttcgctagagtttgaacttgattttttttaattttattttaatatatggtttgtttgattttttttttattattattattatatagattgcaagccaagatgtacttatagatgctcagcaacatcacacaagaagccatgtatgttcttttgtcaaaaatgttgtgcaacatgtttatgtgttcctaaaggagtttatggcaacaaacaatcatgcccttgttacaacaattggaagactcaagaaggaaaacctaaatgcccttaattaattaaaatattaataattagggaaattaatctttttttcccaataattaatggaaaagattaagagtactatagctatatggtcatattgtgttttgtattgcattaaattgatttggagtaattttgatgtaatgttttaagcattttgtatttctctacttgtgttatcatgttgtctgagctgagttgtagtactggagcgatatatgatctatgtattaggattcatatagccgttttcaacttgctcggagatgaagtgttattgtaatctttcttttttataacgagactataataataacttatttattgaatcgagtttgttcactttggagcatttttcatttctcttttctgttcctgttgaaatttaaaatgagttgtagtactggagcgatatatgatctatgtatttggatttatatagccgtcttcaacttgcttggagattagtgttattgcaatctttttttttacaacgagactataataataacttatttattgaatcgagtttgttcactttggagcatttttcatttctcttttctgttcctgttaaaatttaaaatgaattgtagtactggagcgatatatgatctatgtattaggattcatatagccgtcttcaacttgcttggagatgaagtgttattgtaatctttcttttttataacgagactataataataacttattcattgaatcgagtttgttcactttggagtattttccatttgtctttcctgttccttttgaaatttaaaatgacttgtagtattggaatgatatgattatagtccaaatttatataattgacttcaacttgtttatatcgaggtattgggacttgttttcatctaccaagtttttaaccgttttctaatttatttacataaaaataaattattgtcgtgattttttttatagagtcaaatgataaaagatttggttaatattatatattttttcattatattagtatgcaaaaaattgtaataataatatttttcgtgtatattttgaacattcaattttttttgtttaaaatattaaatcgatataatctaatttaactttaaaaataaataaaattgattttttaaaaatataatatgacaattaaaaatggacgaaggaagtatatatatatatataaaaaaaaaactaaattctaatttagttgtaccaaaccttgtttaaattggagaaaaataaaagagatccaaatatattaagtttctatatttacataacatatactaaaaacattgtgtgaaagagagaaaacaaaagagaacaaagttttttccg

SEQ ID NO: 350 - DNA, 4878 bp, Solanum lycopersicum
tatcttaaatgcagtcaattatttatgatgaaagttttaaaatatagctagtatagatgccaaattgaactagtgtgaatacatatatactactgaaaattctcctctagtaaaatacaatgtgaaaggactccaatttaatgaaacaataaaatatttaccacaatggattatggaaaataataataagtgctattttcctcttaattaaattaatttgcctcaactgaaaaaggaaaataaagctttgactactgtattagactaacaacggctaaatttttttttggagaattgaagtgatgaaaatatagcttaaaattattcttacctcagcaagatttttttaaaaaaatcactttgttttactttataacaaagttgcaacactcacaactattattatatttccgtccccaaataaactaaattcattatacgagtttcacttaccatgttccctatttattaaaaaaatcgatcttatatcaacattatacaaataaaaaatattaaaagttctccatatttcttactacaatttgaatgatctactttacaaaataactagcaagtgtgtaaaattttaatatacatattgtatacatactcaatatatattgataaataagtttaatagaacgttaaaaattaaaaaaaatatttataaaatgaaaatgaaagggaaaaaagaaattaattttagtttccttcatttaagcaaaatatcttgaaatgtgtttttgtagtaataaaaatgaccctcgagtcaatccaatacttcctttctttggccaaaacattcaaatctacaaagagcaattacttctcttccaccgttttctattcaaatcctacaattacattatcttgactttcaaaaaaaaaaaagtttctttaccccacccccctaaacccccctaccccacttacttttctcccctatttattccttgctgcaacaaccccttaattctcattagaataatccacacctttccacctctctccattaatactccctttcttttcttcatatatacaaaccccaaaaatacatcaaaactcaaaaaatatgtaaaacaaagagacaatttcatcagacttctgaagatattaaacatcacaatttttattgtatttttctctctctcttttattttgaatttaagagctttcactgtctttcactctgatgaagattctaatataagccccatcatgtgcttctttcaatgttctctttgttttctcttcaaattgaactaattgggctttttgttacattgagtagtgaacaagtattttcagtctgaaatataataattttgtgaacaagttataattataagggtatgggccatgtactagatctctagtctatctttttcactttacatttaatttcatttctatttttgtttatcatttaacaggtgattcttgttttgggttttgtcttttttatttctacaatttgttttctttttaatctaaaaaaaaaagaaaagagtagtaggtatggagtctatataagaagtgtgttagggttgtttatagactaccaaaaaaaaaaagcttaaagagagttaccttttttattttcttcttcatcctcatcaaatatggcttcatcaaatagacactggcctagtatgtttaaatccaaaccttgcaattctcatcatcaccaatggcaacatgacatcaactcttctatcattcaacaaagacctccatgcaatccaggtacatatatatatatatatatatatttacatttcttttttcttttgtaatgaatgaggttttgatttaaattttttttataataattatgattagaagagcgaagtccagagccaaagcctcgatggaatccaagacctgagcaaattcgtatacttgaagcaatctttaattcaggcatggtgaatccaccaagggatgagataaggaaaatccgagctaaacttcaagaatatggtcaagtaggtgatgctaatgtgttttactggtttcaaaacaggaaatcaagaagtaaacacaaacaacgtcatttacaagctaaagctcaacaacaacaccataataataacaataattcatctcatcaacctattattacttcatcttcatcatcttctgataaatcttcaccaaattcattgactttctcaattggtacctccaatgttatggacttgctcaattctcctacttcttcggtgaaccaacaaaactataacgagttcctgtctaacgagcagcctttctttttcactgtacaaccaccaccagtagtaccaactcatgatcactccgcagggttttgcttccaggattcatctacttttactcctcattcttcttcttctggacttcttcttaatgaatggatgggggggataagtactcaagcacctaataattcaaagaaagatgaaaatgacaaaatcaatttgcagtcacagctcatgagttatacagttacttcaactgtttctcctcttgctactaccactattcccaccattagtcacattcaaggtaagccttttactcactcttcatccgttacattttatatgatactttttttttaaccgtttccaaatatcacaagttttaaggatatttttattttttattttcatttaaatctatgtatcgtcaaatactatcatataaattgaaacattaaaacaacggaaaaaaaaatagagtaggggaggactattgagtaactgaaaatgctaatttatttactttttttttaaaaaaaatgttgagtatgtggtgggctagctactcagtacaaatgataccatatctagtatgaatgtgcactttaacatttttttccattaacttcatgacaaaagtgaagatatataaatagagtctagaaagttgaaagccactcattttattttattttagggccagaactgagaatgagaataaatgtttgtctctattcatacgaaatttaatcataataagtaaaatcttccactggcatttcatggaagtgattgatgctatgctaggcctgttcactttttacacagtgttctttttaacaaaggctaataaagtagttttacattttctcatacgttatgttttatagataagacaaggttagatttgtcctttggcttcctcattttctgatttcttgtctacattttttttgtgaacaaacgttcgcatggatggattttttggatttatgtatatataaaattgactactgcattggttacatttatctcatgattgtgtaacgtacgtgtggttgtaggggttactgtggatcctaatgatgcgggtcccacaagatcgacagtgtttatcaacgacgttgcttttgaggttgggataggaccgtttaacgtgagggaagtgttcggtgaagatgcggtgcttatacattcatctggtgaaccacttattactaatgaatggggtatcacaattcagccactacagcatggtgcattttactacttgcttcgcacgtcaagtattgcatcgactcatcatatataacggagacataattgatttggtacgaattcaaatttttattatattttttaacattgcacattataaaacctttctaggaaatacttttttttattttgattaaaaatcatatttgactgcagatttgttgatgttgaagaagaaaaagatgtttggtgttgtgttttgtttcattgtctcttgaagaaaagaaggagggggggggggggttaattagtttaatttgtagtgttaattagtatgttactttaagggacattttagttattacagaaatctaattaagtccttagtcaatgtgtactatgtttcatttttttatgatgaaatgaaactaacaaattattatattataatataaatgcgcctttttgaggtttaattactttattttgatgatacaaataagttgattaattagtaaaatggatgacttcagttgcatttttatttatttttacatgtgatgatatatatgtgtctatgaaggtgaagaaaaaatccaataactgtgatatcatcattaacatattttctggcagctttcatgtttacttgtttgcttattctgcaaggaaagcaaagcatggttgctgtaattaagtgcctttattttcattttataccttattataagtttaagttatgcacgttattatcgcgataaactaactcatgttaaaatttaatcacacattctaaggattacttataagtaaaaaaatctcatgcgactagctagataagaaagctactaatacactaacgaggtatataaattaaaaagtactagagtaatactaatttttatgtatgtaccatgtaatgtgaaataaattcttctatttatcaggtcaagttattggtaattatattgtttatagtaggcaattagctagattaaactatataatataaaaaaatatatattagtaatctttttgggatttctcttttcttagcctttcatatgtaatggaacttgatggcttgaaatgtagtttcatgtttttagacagtcatctctggtttcttcgaaaaagaattctgtgggtaccccttctaattcttaattagttcactattgattttacctctataaattaaatttgagtctgtatgtatatttttgtttcaaactagtggtgtgcatcgacctaagttcgaataaaaatagagttgctaagattcaatcgaaacatttttcctaccctacttaaatagggtacatttcattctataatcagatttcaattataaatttatactgagtttttaaatagactaaaaataaatgaatatcatataaattgaaatgaa

SEQ ID NO: 351 - DNA, 5651 bp, Solanum lycopersicum
  modified_base (1)..(667): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcaagttggaaaaaaaattagattattaaccatttttacataaaaagaaatatatgaaaaattttcaacaacttttaaatttcttaatatggaattaaattaaatataaggtcacttgcggtaaataaataaatttttattttaataagactcctagtcatagccacatacctaccgttttgtcgatatctaagggtaatatcgtcattttaatatgtgggcgaaaattccacgcaagtatagggacttaaatgtaattaaacgaaaaatacagggaccaatcatgatatctcagcatatataaatagccaacttgctgcctctcagaaacgctcacgagaattctgtgttaaacaaatttaaagcttattgtttactcttttctcctccaaatttctagggtttctctcgaagaattttctgtaagtattttttttctcgatgaattgtgatttttgatgtatgtttatgttgatgatggatttgtttgtgtgatttgattgattgttgttttgatttttgtgtaggatttgggaagattgtgattcgtttgggaaaagttggattaggaacaaacatcaaaaaatttatattgtaagtatgatgaatgttgttttcgttatgaatattttgtgaaaaactgttggaatttacgttttctggatatgaattatggtgaatgttgttgatatgattagatttttgtgttcaatgattaaggaatttgtgttttcaaaagtagatctgagtttttgatgattgattttgtttttttcttttctgaatacctttttggttatgattgtcttgctttatggtgaaagttggtgttgatatgattgaatagcttttgttgtatgaaaattatgttaattatgtttcattccgtcttaaggacggatctgtgattgtgatggtaatgatggtatattaaaggtcattatttgaaaaataaaatcactttattccgaaattaaaactaaattatcgtctgggattatggtaatgatggtatattaaaggtcattatttgaaaaataaaatcactttattccgaaattaaaactaaattatcgtctgggatttgtcattttttcttttgttatttcctgcgtattcctgaaatattttatctttatgaaattgattgagctacagttgtttatttattgtggaggctttgcaaagattacattttttaagcttaaacagtagggacccactttggcagctttacttgatctacatatcttttaggttaacttttttgaaaatatatacaagggagatttgatttatcagtttccacggttacgtgaacatgctcctaattggatgacttgatttgttcattttggagaacttctacaaccaaaagcttctggtctattttccttattttaaaatttaaagtagtgatattgataaagtttctgaatcttaggttctttttaactcatgttaaccttaaatgaatagttgttatatagtatatttgatcgtaagtccatgagccaatggctttgccatatggattatgatcacatgtacttttaaatttgcaaaagtttttgtagttcttcctggtgatacctcagaaaattcattctgcttatcccatttggaatgttaagctgcatattataatcttcagtctcctcaatctttttaatggaagagtcacttgataggtcttctttagttgtactaatctccagctcctatttaacgggtgtgtgtgtgtctgatcatgaaatgaagaatctgacttttagaaatataatcttatctgtagcattcacatggttactttaaggatagctgacacaaaggcttaaattttagtatttttttcctaggtattttctgagctctgtagttatgttttcttttacacatgatttggttcctgctaatccttatatcacctgatctggtaacaagactgcctatttccattaatcatccatcaactttaattatctcatggaggaaaccttccccatccaaaagttattagttatctgttgtcaaaatcatcgcttgcctaaatatttatgtttacttttcatattttggaattctgtggctgttatctgcagttccttcttagggtttcagttttcttattgtctagctgtgcatccagtggatttaacttacaagttgttggaatgtacaggtgaatgatctaatggagtcaaaaggtggtaaaaagaagtctagtagtagtagttccttattttacgaagctcccctcggctacagcattgaagacgttcgaccaaacggcggagtgaagaagttcagatcagctgcttactccaacgtaagtatctggatctcatttgttttagaatgccatccccatgagccataataatgagagttgagaatattgtaactgacacttctctttttctacctttgtatgcagtgcgcgcgcaaaccatcctgatattccctaaacttccttccttaaagcgtcaatagacgcaaccaaaaaaaaaacaaaaaaataatttctgctttcagtttcttcttttgtaaaaccctcactccttttcttccttcttttactacttcctgcttttgcactcattgctttgaacattttccgctttaacttcctttgctgttgtgaactttttcataatggaaatggacttgccagtttctgccattggttttgaaggtttcgaaaagaggctcgaaatttctttcgtcgagcctggtctgtttgctgatcctaatggaaaaggacttcgatctctcacaaaggcacagttggatgaaattctcggacctgctgagtgcaccattgttgataacctgtcaaatgactatgttgattcctatgtgctgtccgagtcgagcctcttcgtttattcttacaagataatcatcaaaacatgtggtaccacaaagctgcttcttgcaattccgcccattctgaggttggctgagaccttgtctctcaaagtacaagacgtgaggtatacccgtgggagcttcattttccctggtgctcaatcgtttcctcaccgccacttttctgaagaagttgctgtcctcgatggatattttggaaagcttgctgccggtagcaaggctgtgattatgggaaatcccgacaaaacacagaaatggcatgtctactctgcctcagctgggactgttcagtgtaatgaccctgtttacactcttgagatgtgtatgactggtttgaacagggagaaggcatctgtcttctacaaaactgaagaaagttcggctgctcacatgactgttagatctggcatcaggaagatcctccccaagtctgagatatgtgattttgagtttgaaccctgtggttattctatgaattctattgaaggagctgctgtttcaaccattcacattaccccggaggacggctttagctatgccagctttgaatctgttggatatgatcctaaaaccaatgagttgggtcccctggttgagagggtgcttgcatgttttgagccagctgagttctctattgctctgcatgctgatgttgctaccaagttactggagcatgtttgctctgttgatgttaagggctactctcttgctgagtggagtccagaagagtttggcaaaggcggttccattgtctaccagaagttcactagaactccttactgtgaatctcccaagtccgttctgaagggctgctggaaggaggaagagaaagaaggaaaggagtagtgttgtcttgagggtcgtattgttgtttttatttcagtgtctgttgttttctcagaataatggacttatacgtccaaacttgtgtctgttgggatttgcaacgtctgtgtgcaatttctcaactagtcttgccttttggtgttccaccagaagccttttatgtttctgcactttgaattgtgtcatgttgttggtttctgttcctgttgcgtctatttataaaagtgtgtttgttttgtgtaagttctttgcctctcctgtttttcaagttgtttctctcgttaatgtgctagtcagttttactttctgaaaggcacccaccacctaatgatagcggcttacgactaagcctatcacgagtgcaagtagaataagtctaatagtctcgacccttaattttagatcgatcaaaatgggccatagcccatggctagactccagtgtctagaccagaatattcattataagaaatagatgtagggtaataaccgaggaaaataaagaacgtcaagtagaaaggagcaaggtcttacgggcacgatcgttatattttttatgtttctttatctcaagatgtgtgattgaatcaaaataacttgtatttcatttaagtattagatctcatgtctcagttccaattaagaggggtcatgaaaagaacaagtttaaagtcacgattaattcctttttcgaatcctctgcaattgctcgagtccttcatgtgtgccataaatgacctacaaaaaaagaagaatccttaaacaaggttttctgcatttgtgcaacatagattcaagcgtctaaaccagtatattcattataaataaatgtagacttaattttattattttggtttattttgatatattttacgtatctttaatttaagacttatcacgccacacatcgatatatcccaaacaggtaaattcgtttgggaagacggaaaagagacatccatcgtttaggtttctgagtagctaagataagatagaatagtcttattactcggtgaagtctgatttgagtcctggacaaactgatctctccggcgagcggaggatggtctcatacactataagaaaactatacattcattacatgaggatttttctgggaattagtatgaaaattgcaggaaaataagtttcttgcgaattttcatactaattcccaagaaaatcttcacaattttttttttgtgattttagcaatgttttgattgcgtctatcgtcgttgcta

SEQ ID NO: 352 - DNA, 5312 bp, Solanum lycopersicum; identical to SEQ ID NO: 260

SEQ ID NO: 353 - DNA, 6096 bp, Solanum lycopersicum
atctaatctcgttagcaatgtttaggaactatgactattagtttaagttgttattcaatacttaaggtagaaaaagaaaaatatagcaaaattttcttattttcataaattaggttagtaagtaattatttttagtatgaagataaaagtaatattaaaggtgggagtaactaatatgtaactatatgtcatagtcaacaaatcagtagcatggatttctaagactaccaacttaaagaataaggtgataatttaaaccagtttaggtaggggtaagggtaaaatattggaaaaatcatttaaatatataacttattttattataatttttaaaattttctactattcgaaaaaaaaatataacaaatattactttacgtgatgtatcagtcggatatatcactttacactatatatcgctcagatacatcactttatgcgatatatcgcttgtatacaacactttacgcgttctatctggacgtatgcgatgtatcgggatattgttactttacgtgatgtatcggtcagatacactactttacgcgatgtagaacgttgagagatgttccagaatcaagacacgatgatattgggacgctttggggtgtattcgaatttcaccaaattatttttttttgtaatttgaaaaaaagtccgtttattcataacataatgaaatttgtgtaaaatcatgaaaaatattttaacacaaattgctatgtagaagtaatttccacaaaaaaaaaaaattctaatccgcagctgctaccctttggcctttcctttgtcaaaaaaaataaaatgaaaactaatcttcaaatatgtcatgattcgattagaagaattcctagaaaacctatggttgtaaggtgggaaaagagaagtaattaaaaaaggcacgtaccagattctttaggaggatatgacagcaaaaggtgctaccatatgtgtatatatatatacacacacattctacctctacacttgtaaaaatatgcatagcccgataagaaactagctagctaggagtactcttgtgttgtgttttagctcacaaatacacaaaagttagccatagctagtttttattttgtttatcgtcaaccatcgtcatgcctagagaacgtgatcctcttgttgttggtcgtgtggtaggggatgtattggaccctttcacaagaactattggcctaagagttatatatagagatagagaagttaataatggatgcgagcttaggccttcccaagttattaaccagccaagggttgaagttggaggagatgacctacgtacctttttcactttggtaatatttcttatattttttgtttgggaatatagttaagttgattttcataagcaaagtaaaaagtatttttgtctttttgtaaaggttatggtggaccctgatgctccaagtccgagtgatccaaatctgagagaataccttcactggtccgtattttttccttattctctcttcttttcatctctttcttttttgacctttttacttaattatattctttagtaataatatatgatgatatcctttttaaaaattggaaatacgaaaaggagaaatgaagaggagatttacatgtgagggagcagatggtagaaatatataaatgtgaagatatatattcttgaacttaaaaacaagctactaaaataaaaatgaataaaatatttactctgtcaatattctgtactatattggtcaatgaatatttatattattcatgactttaaaaatagtcaaacgagacataacgtaaaagtcaaaatacgtttaagctcattcatataaatgaatatttttaaaatttgttgcatccatcaaaatatctactttttaaggaatgatatttatttcataatattcatatttgattcgttgatggatagattttattctttaaaaaattaaataaaaaaaataaaattggcctagtcatatccatctaaaatgggtgagattctggtacgctgaccgtcttataattcccaataaaaacttttggagaaaaaagggaacacaaaaaaatgaagtagtgcaccaatagaatcacttctcacctccttatagctagtacggattattcccttcatgtgtgccacagtcatgcacaatccatattataatttccaaaataattagttgttcacgtttgaattgatcataaatgatattaccatttatcctttttacttattaagtagatagattaaaaaatttaagattttcaaaaagttctacatttttaaaaataatcaattgaaggtataaaaaagttgtccttccttaatttctcaagatggataagtaattaagaacaactaaaaaaaagcgaacaaataattagagatcgaatgaatatttatcaatcctcatttcaccaagtcattaaattattttatgaccaaaatgtttactcattttgcttaaatatcaagaaaattgttgaattatttcttatagaaatatcactcaacatcagtatctaagtagtactcatttcgtttctatttatatatcatttttattaaatataaatgttttcttgatatttatttatttcacaaaatcaaaatttgacttatgattactaaataattaatttaatttaattaatcaaaataaattaatttatctcttttgcaaaagttaactttaagagaacactaattaagaatataataataaatttagttaatttttttaaaagatataaaatctaaattagtgacatataaatagaaagaggggaaagtagtagtttaactcttatggtttgataaggtgtgtgctaaatgacaacatctttcttgtctcgtaaagttaacatctttgtaggtggtgagtaagtgagtgaatgccattgaatgaagagattatttgtttttgtcacctttaccactaaagttttgtctatttttattcttcgaattcctccagtacaagattttatttttgatattcctttctttggaattcagtgttggtataaataggatctatttggctatccacatatatttttaaataaaaatcagtatttagtcatttaaattacatttcatggattatactcgttaaaaaaaatatatttaagcaattaaatattatttgttgaacataggaaaaatgatttgaaatatattcaaactttgatcacaattgtgataacaatttcaaattttgggaaggaccttttaccccttgcactatttatagtatattttaaatgtatatatatgtcaacataaatataataaatattgcattattatatatagtaacttgttcacgtggatacatatatacctgtaaaatatactattaaataatataggagatagtaggtcctgctcaaagttagagattgttatagcaatttcgatcaaagatatatttcaaactatttttcctaaaagatataaccaaatacaattttatctttaatttcaatatttgcaaataaagtgaaaaaatatttataccaagtaggatgaattaaaaattaagggtttttttcctcttgttatatatataactaatcgtcatttttttattaatgaatcgtcgacaggttggtcaccgatattccagctaccacaggttcaagttttggtgagaatcctctttttgttaattgtttgtttgttgtcttcccatgtttacatttttttaaaaaaaaacaaactaattttaaaggtagaattaaaaaaaaatcattatcgtatttaaaaatatatttttataataatatggacgaataatatgaaactaacagagtaatgacaaaggaatttatactgagcgggcaatgttgcgttaaatcatgtttgtcctaaacttttaaaacctaggaaagggaatgaaatctattctcaattaacgtgattaaatattctaaacaattgatatcctttaattatgtcccacactacgccaaaagttcttaagcattacactctaaaatttgtatgcataacattaaaagatcattacctatttggctaaaatttttacaataagtttattttaaaaagtgttcctttttttcccctctcaaaaacacacttgtgttactcttgatttttctctcaaaagtttagttaaatacttaagtttttttaaaataatttttttatgaaaaaagaaaaaaaacatttttggctaaccaaacaggtttaggagacttgcgctctgccataagtatttccccattcacttttcttccatttttatttatgattttttttaacatattaagaaagctatttgtttcatgctcttcaataatttcttattctccaaattaacatagatattgtggtaaaacaccataatagttattgtatatttgtataccttttcaaatatatatactctctaataagatcacaagataaaaaaacatttattggtgaataaatttgacataactttaatttaattataacacaaaattcaaaagttttatttctcaacttaaaaatttggtgtcaagtcagaagtagatgtgataatttttgtttttgaaattggagggagtatcttgttgaaaatattggatatgtacataagaagtagtcatttgaaatgcattgaaacttgataaaaacataagtagctagctagtgcatgaaagtttggttgtttatgtacttttaatatgtagggcaagaaatagtgagctatgaaagtccaagaccatcaatgggaatacatcgatttgtatttgtattattcagacaattaggtcggcaaacagtgtatgctccaggatggcgtcagaatttcaacacaagagattttgcagaactttataatcttggtttacctgttgctgctgtctattttaattgtcaaagagagagtggcagtggtggacgtagaagatctgctgattgatcaactccatctactacaaaaaacaaaaaaacaatgatatttttagctaataataaccaccaatatctactacttctcttacaactttagtagtatctatagttatcttttttaatctactcttttacttctttactatattgtcttcctctcaatttatttgaattagtgacttgatatcaagtttcaataaagaaacaaagactgactttagaattttgtgatttacaataagttgtacatatttgtatgactatcttaaaaagttaaatcattattattaaatataaaaatatgattaatttaaaaggaagtaaattatataaaacgttaatttttttttatagtttagctcttaaaaaaaaattataacaattaaaagtattgaatgaaagaagtttgtaactagtctctgttattcctctataaaacagtatattttcttgttacttttataaatttctaagatatgaacttgagtattatttggcataaaacaagttccaataaagaatcttgagtggaagtacttgtagggcagtaaaaaggccgcctctttgtcaccaaacaagttgagtttgctttggaaatacaacagtcgtcatccaacttccttttccaaaaagccttaacagtggatattaatgtacaaacttaccttcgttcaaacgacgtacataatcacatttacattgcatcgtgaaaaattatattttcttcgttcattttaaatgtcatgatttttatttttataaaaaattttaaataacattttaatgtttatattttcatcgtatcgatatgcaaaaaattacaagttatagagtttttgtatatctattttttaaaatatcaaattaataataattaatttaactttgaaaattaatgtaattgacttccgaaaaatacaaatgacaaataaaaatgaaaaagtaaataataaaatctgattaaaactatagtctaatttatataaaggaaccctaagaatcttctaacttatccattacaaaaggatgtaatttatggagttaacagacgtgtatatagatagacttgaaagtaaaagaaaactttaactctaggaacttctctattaatacggttgctaggagctcctaataaaatgtgtctccatccatcaagcaaactacctacaaga

SEQ ID NO: 354 - DNA, 17804 bp, Solanum lycopersicum
gtgaattagtcgttaaaaacaaaatggtatgacagtaaagggataatcgtttgtaaataatttcccttttcggaatacacatattttttacataagaatttatatgaatattatatcaataaaaaattttattgatataatgtttttttatgtcaattataataaaactaatttattttaacatataatgcaaatcagtagtagttgaagtatatagctatagtatactatgattggtatataacatatactcttaggtatcgtcatttaatgactttaaacatgctcattataatttttttaggaatcgcttctagctcttcatacgtaattattatatttttcacttattttttttctaatacgttgtatactatgtattatatactaataaagaataatatagggctagtcattcattcattttaaaaatactaagcagtctagtatatatcatatatgacacaatttatatatgtctggctcaaatctcttttgaagtgaaaaaaataagatctactatatatgaaataatcaactctaacttgaagggactttataatttcgatattagtattttcatcaaattatttcatacgaaattcaagttctattttcatctcatatgcaattttctagatgaaaatcatagcataagctatatacaatttttttaattaaaaaataacctttataataagtctaggaattaagatgaccctgattaagcattataaatgactttatctacttttaaatttgagtatgctatattatcactccaaatttgaaaattattgaagaaaatattaaattaattaattgtttgtattagtattacacaatcttagtcgtaaaaggaaaagaagggggggtaatatagtcatttaggtcacaaaggaggtgaggggaattagagaattcggtgagggagttttgagtaaattaacattatctgatcgattaagaaataagaaaacccaaagcgagtcgaatagaaagggtttggggagaagagagataagaaggggaaaaagaaaagggcagactcgtttattaagtttttggtttaatagtttttaacaaaaattcaaattctccaaaaagaaatacaaaaacagtcctcttcgcgcgctgttgttaagcctgacagcaccggtgggaggactcatggtggctcagatagagaccaacgccgccgctgacggtggtggaggaggaggaggaggaggaatggttggaggttcttcccctcccgttgatgaatcgcaggaacagttagagaagacgaagacattgatttgtgctctcaatttcctctcacgtaatcttccgatacctcctgacgtattcgatgctgtctcttcaatttacaatagcgacgccaacgatgttgatgtcggtgacggagatgcatcccctgctgacgtggacagtttgtctgtgcaagtgagttgtttctcctctttggtttcgttatacaaattctcattgagagtaatctctcttttatgttttttttttaaaaaatttgaatctggttgaattagagtaaattgtagaagaatgttcttatagttcacttacttttagatgctagatgtagatacatggtcacagagtatgatcttgtcagatttagagaagaaaaaaaaactagggcttgatacatttttgttgtccttttagtaaaggtgaggttatttggttaaaagataatacccttgttcatttttacttgtctaatattgacttgaaaaatccttaaagagcaataaatagtgataattttactctatcaccctttcaaatttagtaaattcaatatattggaaaatgactatagttaataacaacggtaaattaggaactaagtgataaattgtctcttggttttccaaattggaaaagtaaaagtggactgaggggagtaacaaattgagttgcgaagtataaatttatgcagtttgttctttgttgattgatatgttatttttgtatgtgttagcatgaagaactaggtatgttgtttatgaggaacttttctcctccatctaaaaagaggaggacctttttcttttctacagtttttaatatttgcataatttgaagtgatgaaacatatctgattgttcaaaatatattttattcattcgttttatttgggatctgaagcatgattgatttgcatcaagaaagaggtcattttttaatattatgccttttaaattagcttttaatgctatcaatttgtttttcttttatgcagaatggtccaggaatgggaagttatggagacctgatggcagatttagaggagtcgttgttgagccaacggtcaagttatacatcaggttctggtttgacaaaattaaaggaagatcgtttccgaagccatatccagcatcgcctaactgaacttgaaggtaatcatagcttagactgatggctcccctagatttctttgacagggttttgtgtgtactcatgctgttttgagcaggatatgcagatctttagaaagattttcgcttcattttgatattagagaacttgaggtgctgaaccttgtagtgatataatatcggctttttcaaatgcttagtaggtatcctccatttagtagatatattattctaaagatttgattatttcataatattcatcagagtcgatctatttagattatgagaagaaggcctctctctctctctctatatatatatattgggtcttgctaattaatatcacaaggaagtgaattaagaaaggagaattgaatggcggtgaaagataaaaaggagaatggagctacagtgaaagacaaaaaggagaatatagcaactatgaaaaacaaaagaagtcctctaatcaatatattcctgtatgttctttcagaggcatttaaggaaagtaaatagtggtgataatatatatatatcgcaaggaagtgaattaagaaaggagaattgaatggtggagaaagacaaaaaggagaatggagcgacattgaaagacaaaaaaggagtatagagcgacaatgaaaaaaaaaggagaacagatcgacaatgtaagacaaaaaaagtcctctaatcgatatgttcttgtatgttcttttgggggcacttaaagagagtaaatagtggcgataatatatacgtgaattaagaaaggttgaatggcagtggaagaaattaaggagcattgagcgacgatgaaagacaaactctaatcaatatgttcctgcttatgttctttcaggggcatttaaggaaagtatatacatcatatacatgcataaatcttatgctaatcaatataaactttttgaatgatacaaataatattaaaatatacttgctactaaatttaaaggatacaagcacaaattgatgaatgatgagttatttgaccataagatgattcgatatagtttaaataactaaatgtagttacttaactatgattacaacaacacaaccagtgcaatcccacatgtggggtctcagagggtgggatgtacgcaaatcttatccactttttgtatagcgtaaaggttacttttgatagaccctccggtcatatgagaagtactcgtcataatatttgagttaggtcaaaaactaatcaatcaaatttatggcatactagtacacaagttttgacgcaggattgctagaaaaatatgacaataaaatagcaagatacaaaccaacattactaatatacaataaagaattagaaactatgtgattactaaataatactagtatactactaaaaaggagaagatgagaggagggggctagcccatgcctctcccacacaaagtgtgataacacctacctactgaccttctaccttagtcatgtccttagttagctgaaattgtgcaatgttctacttaattaccttcccttaattatttttcggcctacctctcgtaattctttgttgcaaccaacctctcacccttctttactggcgcatcctcacaccttctcttcatatgatcaaattatctcagtcttgctcccctcaccttgtctgtcacggaggccattgccaccttgccctatataacttcgatcctaatcatatctattgtggtatgcccatacatctatatgaatatcctcatgtttgctactttcatcctatgaaccatgaacattttttattagccaacgctctgcccatataacaatgttggtctaatcaccactctatagagcttaatttttacgccttggtgagacattcttattgcacaataccctagagatgagccttcattgtacccatctcgctccgatactatgtgtgacatcatcatcaatctcctcgtcttcttggattgaggatcaaagatactcaaagcttcctcttttggctatgacttgaacatcaatcttcagttccgcccctgcctcatgagtttgtgtcattatattttccctaaggtactttgttttagtcttgcttaatctaaaatccttaagactctagagcatgtctccaaacttccaatctattgttaactcccccatgcctcactgttttagccctactttaatatgattttcataccaattattcaacttcaatcctcttgctttttagtcaatttgtactctttaacacggcctttgaatccaacaattgcttaagtctctatttgtggtgtcattaatccctccctacaactcatgaattaagtttttttatgtttcaacgacatatgatttacaatgtgaatatgagcaatgttaactattagttgcaagtacttcacgtgtaattttttgccttgtatttaagaaattgtagccttcttctctttatagttgcatacatttcaaaaagttgttgtagactgaaagcaatatcttatagttgtacataaattcgattagtatgtcgtcctttggatggttagtatatcattgtcaatttcatggtgaaaaactataaaaaggtagtagttatttgtgatattttactggtacatcaataagttttattgatattatagttgtatgtccatgaatcttttgcctggatccaaaattatgactattttaatttgtaaatttggcacaagcatattaacaccacaactactagaatggacaactagtggaaataaaggaaacaacatctataatactatagcaaaaaaatattataaacaaactacagaaaacaacatataataacagaagttgaagaacaagaatatagagtaatagtacaattactagaatggactgtaagtaatactctcctacctactacctttctgcactaattcgggtcctccacaccttcctatctaaggtcatgtcctcggtgagttgcaactgcaccatattttgtataatcacatttcttcaatatttatttggttaacctccacctctccttaatcttaatctatccatagacacttcccacaccttcgcatcggggcacctgtgcatctcctaatcacatgcccggaccatctcagcctcgttttctgtatcttgtcttccattgaagtcacacctaccttgtctcgaatatccttatcttaatcctatattttctagtatgcccccactccatcgtagtatccttatctctgccacattcatttctaaatttgatagttcttgatcggccaaaactctgcccatacaacaacgctagtctaaccaccagtttgtacaacttgtcttttaagtttagtgcacctttttatcacacataactatgaatgcgagctccatttcatccaccgtgcactaatatggtgggtggcatcctcgttattctccccattttcctagataattgacctaagatacttgaaactctctctcttttagatggcttatgtatcaagtcttacttccatattaggttcatgtaccacatcactgaacttacactccaagtattttttcttagtgtgtgatccagttatagagccgattatgggttgtcgaatgggcctcctgtcttcgtcttgcttaatctgatacctttagactcttaaggtttgtctccaaacctccagcttagcgttaactcctcgcgagtctcatcaattaaaattatgtcatccacaaataacatacatcatgacacctcattttgaatttgccgcatcaatacatccatcatctaggcaaataaacatgaactcgaggatgatccttggtgcagcccccatcaaatggcaagtgctccgagactctacacattgtccttactcggattttgactccatgatacatgtccttaattgacctagtgtacgtcattggtacacttctagtctctcaacacctccaaagaccacccttactaggtgaatgcttgcgtagttgagcgtcctgtcataagtccaaacaggtaaaactacatttttttacttgtgcttctaagggtgatgactatgcattttactgatttgtaaatcctattatataagctcaaagtaatcaaatttacttgctaaccttgatcattttcttcaccagataagataattaattagtagtttactttgataatggatgatttttgaaacaattgaatcaccaaaagtttaccaaacacatcttcacttttgccataattcaacatttaataggatccctattaaatgtccaactccattttccaattcacacatatgtttaagggtttaggttatcataaatatactctgtccgcttaaatttgtttgtcttatttaccttttaagtccatttgaaaaacaatgcctctttccttttttgacaactctttattctaacttttcacctacataagattaaagagcattttggtacattctacctatctttaatttaagagcacaagatctgaaagttttccttactttctgaaactccatgccaaatcaaaatcaaacaaacaaattgaaatggagggagtatttattttccagtccacacatttactatggccaagatttaccatttaataacagccaaattaaatggctaacttaatttctcaatccacacgttcacccaacagtagttcaaatatacagctaacaatgagggcaaattagtcaatcaatttttgaagaatgttttggtaaatcatcttttaacttgatctgttctactcttaggataacatttaaaattttattatgaataacgtaaggttttcactgtaaatatgtatacacaacagtttagtttggtttcttatttctaggactgtgatgattaaggtcagaagtattattatttctaattagttatctcttctatcattggcgcagctagaatctcactaagagaattaaatatgaaaaagtaagcacccagaaaactcaaaaggattcaacgtatacgaaatatacttcattattttttaaatatttacactaaacttttggtggacgaggtgttaattaagtccccttaaacatagtctactatcaaaatattgctatttcaactgaaaaaatgaaagaaataaaaataaacttaaaccttgtggtggggcgacacgaagtggatggaaaatagagaaagtgagacagataacttaaatttttgtggatcataagacctcgccctttcatatatcgccctgtttctctccatttataatctatagttggtatgcatctgaaatctccttaatgtaagttagaatgaagcaataccgcttctccattaaaaaaatctgttcaaagttgctctttcttaccaacattataatgccatcctgaaaaggttgtcttttcatatgctttaacgattgtcgtattagaagcagccaatgatatatgcataattagaagtctcaaagaattcaaagcaaaagcaacaaagcaactgaagcagaagtctatttgataggcatttaatagctaacagtaatataatgtgcattaattagtagatatttaggttgtattaacttaaaaatatatatttagtctatgttgacttattgcaactcttctgattctgcggtttttacagtaatgagggaaaaattgactatagcgaggttcatgtactggttatgaatgaataagttatttatttcttcaagggcattattgtcttcaagggtattttattttttttaatatttttatcttgaggttcccacttatagaatagtatagatagatggataaatatgataaatagattgatcgagtcaatagtttttgggtatattctcttcaaatatgtgaagtgccaaccgtacagctcttgataccaaaacctgacttatcttcattgttatcttttctgtcagattatggagtatatgagtttgagcattatctttgacacatgttatgcatttactaaattttatgtagatttggattgttgtaagtgtagtttgctaattttggcttttcttatttgatggagtaatgaattgcattaaaaagagggcatcaagtagatgcaacagtacaaaaggcatagttataaggagatgaaatgacaaaaaagtgaaattagcccagctcctacagagtgtgctagtctaaagtaagggtactgacaatctagagaaaatatcattactaattacaggagacagttctgtccagcaaaaaagattaattaaacaatttgctttcaaatagcgactaggagttgagcagccatcagagcaccttctattcctctgtccatgggctccagaaaatagctgcagaatcatcaaccagattttcatgatggccttatcaacattccataaactccagcttaactgtgcccgtctcaggttctgaggcatgaccaagcttagttcaaacaacctatagagcatgctccatatgtcaattgctacagagcaatgcagcaaaagatgattaactgtttcctcattcttcctacagagggtgcatctatttaccatgtagaaacctttcctgttgaggttgtcttgtgttaacaagcttcatgtaagtcaataattgaagcaaattatcaatctccagggccaaaagtgaatcttctgattttgggatcagatctgcttgtagcaatccttaactgtaagtatcctgttcgtaccccaatacatgtcaaaaaggtctttaatgtcactatcatcctcttagtacttactatataattgcacctctcgatgaatgtgcaacatactaggagagataggattaagaacaaaactataccgtcctaggtggagggggcctttatggcggacaagatgaggaagcgagattgagatggcttggacgcctgaagaagaggtatgaggacacaccagtgaggatgtgtgagaggttagctgtagcaggagttaggagatgtacaggtaggcccaaaaagaactgggggaggtgattagacaggacatgacacaacttcagttgactttggacataaccttagataggaaggtatggaggttgaggaattgagttttgtcccactttgtgtgggagaggaatgggctagcctcctcctctcctcttcttcttttagtaatattatttagttatcgtgtagtttcttgttcttcggtgtgtattattatctgttgttgcacttgtcttgtatcttgccttctattgtttcttacaatcctccgttggattcttttcttttaagctgagggtctatcgtaagaaccctctcttaccccttaaagttaggggtaaggtctccgtacatcctagccttcccagccccacttttgggattacattggtatgttgttgctgtgttggttaattttaagttttatgtaccccccacccctagtaatatttgcaccgaatttaaataataggattatcttgctcacttgtagaggtaatcacgcaactggttgtgatatatttatattcagtagtgctgtatgtctcttatgccagcacttcttatacttgtagaaatagcttacactttcatctttgaccagacttgccaaccagcagaggtgaggacttgcaatcgaagtgcttgcttgaactttatgaattaaaggtaaaggtacatgtggagtattgttaattagacatataactgcttctcatgatctgtcaattgcaattatgtataagagttttgcttttgtgattaacatgttcatcaaagttgttttgaaccacaccagttatcttgcaaatcaatttcaagatgtccttgccacttcaaaggagtagttacctatgtaataaacctgagtatttctgaatttctttgttaaattttaaaaggcatggtctgcctctaactattatttactggaaatatctccgtgatgaaaaaatagtattacattttgctgcagtatacgaagctctcatcttgggatcccactattatactctgtataacttatgagttatgagtacaatatgaagatttctgataattatgggatatgatacacaaatttgagggcaatactgtctccactaagattgtttatcatttttttggccttgtgattgaatgtttacatgatcaaaagaaaacataacaaatttgttttggatttaaaaatggtaccatttcccacctatacgtacttgcgcaattcagaatttagctcatgtgctttatcgccctaatccccaatagtacctgccatgctcccgaagaatttttcatatcttttgagatccaccctacaatatgggtaaaaaaggactcttaataaagaaagtatgttctgaaaaaagcaaaaagcttgcctttcaagatgcgcttgaaagaagggctcgcgtttgattagctatttggtaaggctatagtttaccaaggtgatgatcaatagctatcaaatcgtcgtagctcaacgagttgaactaaagataccatctattgggaaaccattccatctccattgtagttaccctgagagtagtctatatcttcttcatcatctgcacctgtgcatagtctaaccaccacctatttaagcttctaattttttgttgtagaagtggtgtaggtggctggatatggattgtcttctcatcattatttatactttgcagttagcagatttacaacaaaaagttcggtctgaagtgagttctgaatattggcttcgcctgcattgcgctaatcctgacaagcaattgtttgactgggggatgacacgattgcgacgccctgtatatggtataggagatgcctttgctgttgaatctgatgatccattgaggaagaagcgtgatgcgcaggtaaagtgatagatgcctcggagcctttgtcaattgtgctattatatctacatctgtcaagttaatgtttttaagcacaacgggttctgattctttctttctcctcccaatttcagaaatgaaatttcatcttgatgtaattaggtaaaaaatagtcttagtcatgtcttctatctattggttaagttgagaagagagctttgctgagaatttagattttaagaatcaggcactgtcctccattcttttgactccttgatgggaaacttttgaatgcaaaatttacagaatttgatgtcagaagcctgttggtaataacaacaaaattttgcagaggttgtcaagaatagaggaagaggaaagaaaccgcgtggaaactacaaaaaggaagttctttgcggatgtactcaatgcagcacgtgaactccaattacaagtacaggctgttcagaagcggcggaaacagaggaatgatggtgttcaggtatgacattatttactttctgctgtttgttctactgtgcattcatttgttcaacaattgacaaataccaggagccaataatgagttgtgacctagagagtggatgcattcttcacctcttatactcttagacatatgccggattttatcttggctaaaatgaagtcaatctattttgtaggcttggcatggaaggcaaaggcaacgggctactcgtgctgagaaactgaggttacaagcactgaaagctgatgatcaagaagcttacatgaagatggtggaggaaagcaagaacgaaaggttgacaatgcttctagggaaaacaaatgacctcctgggtcgtttgggagctgctgttcaacggcagaaagatgctgatcatgatggccttgaatctttggaaggttcagatgctgaaatggctgctactaagactgatactcctgggcagtcgcttcctgaggaagaagaggatgtaattgatgatgagtccactcatgatgtgaagactaatgacttacttgaaggtcaaaggaagtacaattcagctgtacattcgatccaggagaaggtaaagaggcacaccgcttctctgttatcttttacttttaattcccagggatattattgaagagttgtgtccaagttttagaatggatgttaattgcaaaaactggaccttccggaggttttcagatttgtattctcatcctttctcctatgtctttggtcaatgtgcttgagtttcctattgattgtgacacagtgtcttctcattttaaagcagtgtttcaatagtttgggtcatagtgttcgattatttcagatgacctcgtcagcgttttattactcgttactggtgtttggttattacaaagaaaaaccttctttaatgtaatcatgaatgttatttagtgtaataaattagattctgcagctctatcgtgtaatgagaatactctgttaaactgattcgtccctcgagtttctgttcttactttttaatttgatggaaagactagaccttagcaaggtgccaaaattattagaattggatgactatcaagtatgttgtgacgttctttttacattacaccactttatgtcatgtagctgagctaactaaaatcttcccattttacctccatcccagctccaccattcgggttttatgatggattttctttaaaatatttagaagcgaggaatctgtactagtttcatatcactgtacattcaattttgatttcgattctccagtcccaaaatatgttctcatgcccattgtttgtttctaatctcagctaaatggcttaatgctgatgtacaaggatctgtatctgatacaatctccactaactaactccatggcaattgcaatatactagctgttttccctttcctacaactgaaattaagtatctgcatcctttgttgtgttattgatgccgcagatctaatgatatttgtaggttacggagcaaccagctatgcttcagggtggagaactgagatcttaccagatagaagggcttcaatggatgttgtctttgtttaataacaacttaaatggaattttagcggatgaaatgggactcgggaaaacgatccagacaattgctttaattgcttacctcttggaaaacaagggtgtacgtggtccccacttgattgtggctccaaaagctgtactacctaattggattacggaattctcaacatgggctcctaggtatgcaccagtctctctctctctcttccatgcagggagcacaaacacattgaatttgtttgttaatatgtgcactgtacatcacatcttgtgagaacttttttccttgttgcagcattgttgctattctttacgatggtcgtttggaagaaaggaaggcactgagggaggagttgacaggagaggggaggttcagtgtgttgatcacacattatgatcttattatgagagacaaagcatttctgaagaaaattcattggcactatctgataattgatgaaggccacagattgaaaaatcacgaatgtgctcttgcacggacacttgtgtcagggtacgtgagatgtaattttatgtttgtcaagttgctaatgtataagaatgttaatcaaaaaggggaggaataatagcctatggtgtaaatcttcctattttatgagatttgggtttgctcctctctgcttatttttagcactcacctttgctgatgaaggtataatctgacacactagcacataatcgaatgagtaatttgtttttttaaaaaaaaattaattgtggaatatgccaaaatctggaaatcattattcttggcagttcaattttacaagaaaaaaaaattggatgctagaagcattctctaattgaggtgtgtaatatttgcagttataggattcgacgaagactcctattgacaggtaccccaatccaaaacagcttacaggagttgtggtctcttctcaattttcttcttccaaacatctttaattcagtggagaattttgaggagtggtttaatgcccccttcgccgataagtgtgatgtctctctaactgatgaagaggaactattgattattcgccggttgcaccatgtaggttttggttttagtaatcactaatatacacttctgtcatgcctgtgcagtatttgttgcacctttacaaatgcactttctattttccttatctaatgtttttgactacttttaggtgataaggccatttatattgaggaggaagaaggatgaagtggagaaatttcttcctgggaaaacacaagttgttcttaaatgtgatatgtctgcatggcaaaaagtatactaccagcaggtcacagatgttgggagggttggattggattctggtgagtagcaggtgccctcaagaaagtattgccttcaattcattccttttatgcatggttgactttaagaactactttttgggtgtgtgtggaggggtcatggacattttatagagagggataaacaactttgcctgtatagtactctttctttctcccccaccccttcccccccattttccccttcctcttgggccttcagggatccattgctctaaaatctacatcctcaatgattccttgtataactcgtgttcttttttcgtctcccctcccccgagtcttttggcaatcattatttgctgactatgtgacttcgcaggaactgggaggtctaagagtctgcagaatctctccatgcaacttaggaaatgttgtaatcacccttacctatttgtggccgagtataatatttatcgaaaggaggagatagtgagagcatctggaaaatttgagcttcttgatcgtttactacccaaacttcgcagagctgggcacagggtccttctcttctcacaaatgacccgcctcatggacattcttgaagtctatctgcaggttcatgacttcaagtatcttagacttgatggctcaaccaaaacagaggagcgagggactttgctaaagcaatttaatgctcctgactctccttactttatgtttcttttgagtactcgtgctggaggactcggtctaaatctgcaaacagcagatactgtgataatttttgatagcgactggaaccctcaaatggaccagcaggcagaagatagggcacatcgaattgggcaaaaaaaagaagttagggtttttgtgttggtcagtgttggatcaattgaagaggtcattttggagcgtgcaaaacagaagatgggtattgatgctaaggtcatccaggctggcttgttcaatacaacatctacaggtttgtcatgtacacatgtagttttagagaactctccacacctccaggcccaagccttctttaattttcttaggggaaaggaaacaaattacctaatagttatgtacaagttctttacttgctttgaaggttgaccgaaaaaatcaggttggattataagaaaaatttgcatttaccatgttttacgtgtgtactttcaacttgttagtactaataccttttgttgacatgcatcaagcgctttaccaagttccacctgtgtattttcagcatgttaagattgtgaatgctgactaatgtttctatccattgtcttgattttggatcctcttcataatgaaatctaacttgacattacttgttcatgcagctcaagaaagaagggatatgttggaagagatcatgcgtaaaggtacaagcactcttggaacagatgtgccaagcgaaagagagattaatcgtcttgctgcccgctccgatgaggaattttggctgtttgagaaaatggacgaggagagaagacaaaaagagcgttacagatctcgtctcatggaagatcatgaggtaccagattgggcttatgctacacctgactctaaggaaaagggaaaaggattcttatacgaaagtgctaatatcactggaaagcgacgtagaaaggaagtggtttatgccgatactttaagtgatgtacagtggatgaaggctgtggagaacggagatgatttctttacgcaatcaagtaaaggcaggaacagggaccatcagtcagtctcaaatggtgagttgcctagtggcaatgctgattctgagaggactggacatgacttgaagcccgatactgtgtctgtggcgagtgaggcaacaagtgaagatacctatggaagaactcccaaaaggttcaaatccgagagtgcaagttccatgagaaatgattatcacgatttgactggccatagtgtggacggtttatcgtggaaggcccacaggaggaggagatcaagcttaatatcctgaggttgcccttgtaaaacctaggaattaatttggccagtgaagtcattagtggacataggggagcatttaagatctctaactatggttctagtcgtctgtttgactcagtgtcttacatgtatattagcatctaataccttttaggttttgcatttgctactagttaactgtgcagtagtggaaaaattggagatgtaccattagctttttgctacaattcttaattattctaatttggagtcaatggtggattaagtttcagtagcttggctgccatgtccagcatattttcaagttgatgttacgagctagttcactattttgaaggctgtactcttgtccagtatttaacagacccagaatgtggcattgtattgcctatcaaattttactttaaaaattaaacagcctttcaactttgaacaagaagcaaactccctcttctatcctaattaaatctttaaaatgcctactattatcaactttgttatttacttttttgaaaaattatgacatctttatttatttattttgaattcatgtaacaattttttcataaaaacacattatcttttggacgaaaaagtgaaaaatactaatgcattatggaagtagaccaaggacttcacgatgattccggcacacgtatttcgttcaccgataaaaaaaaacaagtcaaatgcatcatggaaattttaaaagaaaagaagaagattaaagtctacataacacaaaagaaggttcaacataaataaaaagtagttctctctcgtaccctacatagttcaactagagacctaacgtgaccaattaaggcaacagttcaattccaccaaatttaaattactgatggaactatatgttagaagcacttgctggaggaacataatatggccagcttagcataaagaaaatggtaaaactaaaactgccacatgcagaaaaatcgtcaagtactggattctaattgctatctggtgcgtgtgcgtcaacacttgcctcttgcttgacgtccaggtttttcagttttgattctagttcatcctcaacgtcctcatctccagattctttctcctcgtcaccctcgtcttctccttccgggtcattatcttccagggatgcaagcatttcaggagatttcttgaagatctctttcaactcgtcaacgccttcttctgagatgaaattcccattaacatttagtaatttaaactcatctttctgcagcacagtttgagccagcaccctagccccagccctcctt

SEQ ID NO: 355 - DNA, 2852 bp, Solanum lycopersicum
aattatacaaactttattataacatataaaaatttgctatatatgaaaattgcccataaatatatactacgtaatggtatatgtctatttagagataaaagtcaaatatttcagctatattacaaaactaagaattaagacagctagcagagagacgcgtgcagggagaattaaaaagcggcttcaggaccagattcaaattttatcgggttctcatttttaagatgatggaatcaattgcagatagtaaaatttttaaattttattcttatatgtattaaatatattttttttaatggaaagagacatttagaaattgatctattccaaaatttattactatgtagaaacatattatccttcgttagttaggctagattatgactttaacaacctcacgagttgaggtggagacaaaacaccttctttttagaaagaatattgtgatttaaaatcaatttatataacagataacttattgtttcaaattatttcattaaagattaaaataaaaatcttaaaataattctttttagatatatatgaataattaaatacaagatatttaaattttctttccaatactattaaatttgctaaattttggaatttgaacggagagattcagtcaaatatgtacacaaatgcatatatatggtaataatcttaggaaatatgccatcttactgatattctatcctttgttccggctcattgacagggaaaaaaaaggaggaggatatttttacttttaataaactctgtactatccttttcactgagaattttttttataatcatataaatattcacataaaaaacttattcacatcaactcaaattatactgcataaaagaaaacaaggaaaagctatataaagtacccatcataggtttgtcatgcagtaaaaacaacaactgcttccaaaatatatttttaatagctaagacaaattcgaattcagattaatggaactttacaaccccgtaataatttggaggtgaaagccaaaagagtcgcttacaaaagcccctgaaaacctttaaccttcttcccctgcatctcttatgctaatcacttcccttgcttttataacctctaaatttccccatgtctcgaccacaacaaaaatatcgaggtgttcgccagcgccattggggatcttgggtttccgaaattcgtcatccttcattgtaattcttctccctcttttctcttttacttacaattcgtttcatcagtcaagagcagagctagcttggagttgttgaaaatcttaatatttgtttcagtggtcaacttaatggtcattgttagtcagaaaatgaaaatcttaatagttcagttgattggcttgatttttcatattgtaatctcctccatcgccctaatgtaacaaaaataataatcttgtacaggaaaacacggatatggctgggaacctatgagacatcagaggatgctgcgagggcatatgatgaagcagcgagactcatgtgtggttcaacagcacgcactaatttcccatacaatgcaacagaatcttcaaggtttctgtcttctgctttgatagctaaacttcaaagatgcaacatgtcatctctcactgctacgtcaagaagacctggaaagacaagattggaagataaaaaagagaacgagatatccacgcttgttagagacacgggagatggagaagaaaggcagagtgagagtgcatcacaacaatacatgaaggcacttgaagatgaacatatagaacagatgattgaggaattgcttgattatggatctattgagatgtgttctgttcgcaatgaataagacataaatgcaataattagcttcaaatgaaaatcattacgtacgtttttgtctatttttatttttatttgtccactgcactaaacagtttaatctatttattagaatttgtgattcgaaaacaaagtgtgaactcatggaggagtgatatgatcctttttttctacaaaattctgaaacttaacagacacagataccttgggaaagcagtaagctttttgactattgatttttcttttatgttctttcttctgggactagatctggtgaatccacaaccaaataattcaatagcagaaatgttgcattcataacaaggtaatatcaacaatttacgtagcctccttcaattttcaaaatcaaataattcaatttttattataagacttttaaaataaatttaaaaattacgtaaaatattgtaagttctaatcttacaataatttgaatacacatgactcacgaaatcatgttaatcgtttctgtattgttttaattttattacgtgtctcgtaagtgaatgcatcctaacctatagacctacataatacaaagagacaaaaagagattggaaatgcgatcaaaatagtcttttctttcgtatcagtaacagtacattaaataggaaatgcctaattgaatttgacgaagactacgattagaatggtgacatcttaacatattattgaacaataatacatcagttgaaacaatgtcaaattagttgaaatttgaaatataaaggtgaatatacaagctattatgaaaaccagaaattaaaatacgtagcataaatgcaaattgaagggaggttttgtaaaaagtaccgttgctaattattatgttgcctgttttaatagtgaatttgacgaatttttaaatttaaattatattacattaatttgatattttaagaaaaaaaagatagatattaaaaaggtaaacaaaaactacaataaattacaagctttttttttgctaacatcatgaaatgttaattacagttcttgaaaaagtctttttgacc

SEQ ID NO: 356 - DNA, 4991 bp, Solanum lycopersicum
ttcagcttcgaaaaagtaaaaacagtacatcagaaactgctgcactcgaaagtaccaataagcccttcacttcacactgaaccacttctcaaatccttcacccagctcaagggcattataggaatttcacaacacgacgccatttgagccagttcccttttctctgtatcggtaagaaatagtgcacaaatgaaaactcaaatctccacttccacgcgcatcgggtgcgcgtgggtaacgatgccattttatgtgaaaatatttaggataaataaatattttctctcaatagtttaaaaaaaaaaaggataatgtttggttaaagtaattaagggagtgattttgaaaattcctttctactctttattctttcttaaattggaaattaattaggtaaaggtaagcagtcacatcaaaattgaaagttcacttatcctatttttgctaatgtaatgaacttttaaaaaagaatttattgagaatgttttggttaacagaaattgatattgaaaaaaaagttttatttaaaatataaaaataaaatgattaatcgattgtcttctgtaaatttatttatgtgaaatttgaatagttatttatcgttttatatttttctttgacttaatgatatataaaaagatcaatttttataatcgaagtttcaatgctttacattttcttaaatatattctttttcacgtgtctatatcaaaacacaagagacacgtttgaagttcctgcaatactcaaaaggattgtatataattaaaatgttcaattaatgaatattgttggtaacaaaatgtttatattattacttataaagtaaagaacctttaccttccaaaacagggagtactcaacacgcgcctttatttgcgagtatgtatgtaaaccctcgcagaaaagataactgcgtctccagacaagccacaaaaactaaaatatgtatatatatatatattttaaaaaataaaaatgaaaaaacaaaaagatagagagaggagaagatgaagggcactttactacttttttatgttgcacgcatccatggcagaaatcagaaggaaaataagagtagtattacaagggcaacaagaagaagagaagaaaatagctaagccaaattcttgctaacagaaagaaaaaaacccctttttatttttctaaatcttctccacaaactttggcttagctatttggtcttattgagtaaatgattatagtatatgaatgaggtgggtgtccttagatggacatctccagtttgatgcattaatttagtttttatttttaggttttgatttgtgggttggtactttagatgaaggggatgcccttaccctttgaatttgaggggaagggggtgttagaattagacgttttgttcaataaagatagtatcttgaattcttggagtaaccacaataccagcaaagaaagtagtagttgttgttactttgtaaatagtccaagtgctgtcctggatactataaggagtccaaggcctattaattcctcttcaacactgtcttcatctttgggtggtggtggtggtggtggaggcactgcttccacagacactgcaggaggaggtgtggcggcagtttctgcaaacccatcttctaaatggcagcagcagcagcaagacaatactactgctacaagctccaatgtgggagctgaatctgagcttcaacaagttcaacccccatcttctcttgagatgggtgctgctgccacgggaggggataaatgtgctatggaggagtgggaaggagggttatcagagtccgtaatggcttcaccttgccaagaacagtctatactaaggtggatcatgggagatgtcgatgacccatccatggctaacttgaataaggtgttgcaggttagtggtacaggggactatgaattcaatggaggatttggggttgtggatcaaggttttggtgtagacccagttggccaaattggtagttttatgcctgcaattagctcatctgtttctatgtcaagttcaagttttcctaccaacagaatgaacagtgacaagattggcttggtttctaacccacccacaaatctccctcaaaatccaatctttccttcattgtctaacaatcttgggccaattgcatttggccagacacagcaacagccgtttgagagcactgatttgaagcctcatgctttcaattcacagttcttgataaaccagcaccaaacacagattcctcagaacccatcgtttcttttgccactaccatttgcacaacaggaacaaaatcttgccttgccaccgcaggcgaaacgacacaaccccgggaccatgggagggcttgaaccgggctctcagatctccaaaggattgtttctagatgcagggcaccagcagccaacaccatctcaggggcttgctcatcagctccagctacttccccattttaggccaggagcaatggggacaaagccaaagatggtgggggaagaaatggctcagtttcatcaactacaacaacagcagcagcagcaacaacaagcgattattgaccagctattcaaagctgcagagctggtccagacagggaatccggtactcgcgcaagggatattggcgcggctcaatcaccagctctctccaattggtaagcctttctatagggctgctttttattgcaaggaagctttacaattgctactccatgccaacaccaacaacttgaacccatcaatggcctcttcgccttttagtctcattttcaagattggtgcctataagtccttctctgagatctcaccagttgcacagtttgctaattttacttgtaaccaagccctgcttgaggtcttggatgggtttgaaagaattcatattgtagatttcgatatcggttatggcgggcaatgggcctcccttatgcaagagcttgccttgagaagtggtggcgcacctactttgaaaataactgcattagcctcaccatccacacatgaccagctagagcttggactcaccagagaaaatttgatccattttgctagtgaaatcaatatggcatttgagtttgaaattttaagcattgattctttaaattcaacgtcatggtcactgcctcctttagtctcagagaatgaggcaattgctgtcaatcttccagttagctcgctttcgagctatcagttgtcccttccattggttcttcgttttgtgaagcagttgtcacctaggattgtggtttctgtggatagaggttgtgaccggactgatctaccatttccaaaccatgtaattcaagcccttcagtcctactcaaatcttcttgagtcactagatgctgtaaatgtgaatttcgatgccctccaaaagattgaaaggttcttgctccaaccaggaattgaaagaattgtaatgggtcgttttcgatcccctgaaaagacgcagcattggaggtcactgtttttgtcatctggattcgccccattatctctcagcaattttacagaatcacaggccgagtgtgtagtcaagaggactcctgttagaggtttccatgtggagaagaggcagtcttcacttgttctctgctggcagcggaaggagctcatctcagcttcagcttggaggtgctgaggagcaggaattaaacttgcagtttccaaccaaccatgaaaaagaaggtgctgcataagtcacaatcactgttttagtatctgaacctttcaatttttgttgcccgcaatttttatttgctaatttcttgtggcataggcagattgtttcggcattataagaagaatcagtcattctgttaactgttatgctatagttccttatatcagggtttatgttaattatggtattactatcatggtgctctatgattttccggaggtaggccctccgatgcttctagttatgccaagaaccttgttgtaatcttgacaaaattacaaaccagaaattttaaaaagatggaattttaacccatttcattgatgctcctgtgtgatatatagcattgattgttccactagcatgacatgctttagtttttgattatttacgtcctgatctggatatttttgttgttattccatgctattcctgaaaccaggtatatagtgaatccagagttcatattttctccagggattccacgggtggaatatctgtgatatcggtgaatcttctgattaagttgctaacacatgtcattgttctgtctttagctctttaaacattatatttgctcaaactcttgctctttattactaatttgaagttatgtcatctgcattagttattcactagaatccactcttcagacacagaaggaattgcgtaacatagataggagatggtcagagaagttatatgaaaaacatcctcatgttatacctttagatttaagaatatttggttatgatatatgcttaagttgacacactgtgattagctaccacacattgcatatacttgtagcagggcagatagaatgttcctttcttcagtggatatacatgaccatttctgactactccagttgtctaggaaatgtggagttctagtcgttctgttatcctagctcatccttttggagaactcaattcatcatgttttctatggatttcgatgtgttctaggaaacaacggtgggatgttggcctaaattacatgcaaccttagaaactataatgctacttgctacggcgttgctaattatctatgaggtagttgcattatagtattacttttggtattaaataatgaagttgattatttttgtataatgtatcacgttattatgcatgccaacacttgtattatatgcattataagacattgaatttgctgctctttatagtctataatttgtttaatacctgtcctaatcaaatcacatggggttagcaatattggacccccacatgagtagtttaatctctctctctctctttcatttccttggaagttctgctgcattcat

SEQ ID NO: 357 - DNA, 4947 bp, Solanum lycopersicum
ctataattacctttttctcacttctcgtttcccgatgggtaaaagtaaaacacatgtcaccaaagttaaaatgacttttttaccactttcttctcgttaatcctcaaaaactgacaaataacttttgttattttactcattcattttaaattccaaatttcaaaatttgtactgaaattgattaaatttatctactcttatctacaatttttttttgaattaactagtatttaactataggaattttaaataaaattttcataagagtaatttctcagatttttactcataacatttaatcttttcaaaagtaaaatatatgttcaattataattctaaattaaaaaattatatacttcaaaaacttaaaatttcaagtttaaaattatgataaaataaacgttttgagttactaatatgaaaacaaaattttatttgagattgtttttttcttaaacgagtcttattttctatattcagctcttctcttatttgtgttaaagaaaaaataaattgacgataattcttgatcgaaaattagctcgactcatgttgactgacgatagataaaaattagtgaaagtagaaagcattgtatagattataaggaaaaggaacaaatatatctctaaactatcgtaaatggtatgcagctacctttatcatactcttggacatcaatatcattgtcgtaaaaaaaactaaaacatatatgcccttcactgtaatataaataccgatatgatcgattgtggcattataataattatgtcacaaaaattcaaattactaaagactttaagtattaagttttcgatttaaaattaatagagttttaatataaatacacgtgagggggggggggggagaagggtaaatatgaaaacaaagaatgggggtgaagaagtaccgtagagtagagagaaaacagaggaagatagaggaaagagggccaccttgttttacctttttttttttttttttttctgatgcagacatccgtggcagaacagagggtgactctacagactgcgacataaaagaggtcagaacaaaacaaagaaaaaaaaattaaagctgaagaaaatcaaggaaagcttagctactggccctagcttctgtagtctatacaaagaaaaaaaagagggaacccatagacaagaatagtgaagagcaagaagaaccagtggattatagggttatttgctctaatggaactcaaatggggaccaagtttgtatctttacagcaaatgactctgttttatgtttgtggggtttgtttttctgtggaaaagaagctgtatttgaagaaatcttggtagaaaaaaagaagatcttgaaggtaagaaaatgaaagtatcttgttgatttttttcaatgtttgtcagatgaaatgaagaccaagttcatatttttgaaccaatggctgttaaaatcttggtaaaatataagatccgtcaagtagcaaaaaggcaagaaaaccaattttttccctcttttgttgctgtttttgtggtggggtttgctgttttttttttttgtttttctgttcagatgattgtaatacctcaaagtaataacctaccagcaaaaggggttcttggtgtttctggttttgtgccttcaatttcttcatcttcttcaccagaagcatcaatttgcaagaaagatgcgaactttactagaaatgaaccagtttctgtgttggatacaagaagtccaagtccttcagcttcatcttcgtcgtgctcttatggtgctcaacatggtggaaatactgcagttcccggtgtcggaagtgggaaaactgatggcaggaaggaggagttagtgacggagctggagccattcacggtagggttggagcctgaaaaatctgttcttggatttggagatttggataatttgttgcctgaatttgccggctccgaccaaagctttctcaggtggatttccggtgatgtggaggacccgtcagtcagcttgaagcaattactcaatggggatttgggttgtggagtttctcttcaaagctctggatttgaggtttcagctacaggttctttagctcattcagataatgtctctttttctggttcaaatatctgtctgaatgccaacattgaaaaacttagttctgtcatagattcaataaatagtcgaaacaataacttcgaaaacccgaatgtcaacccttctctagaacagaagcctcaaccttttggtccacaagtaatggcaaaccaaactcaattccagaatgcggcttgtgttaacatttttgggtcatcatcatatgacatcaatcaagaacagcctccgcccaaacgccacaattcgggtacccttggaggagctctattgcctaaagttcctttttttgatgccaattgtgacttcatgttgaggaaacaaccattgggacaaatgcagccacaagttaatttgctgcctcctcaccagtttcagccaaagccattgattgtacctaagcttgaggcagctggtggtggtggtaatggtaatttgatggtgcctcgtcatcaattgcaggaacaacagttcatttatgaccagatttttcaggcctctgaactattgctggctggacaattctcaaacgcgcaaatgatattggcgcggctcaatcaacagctttctcccattgggaaaccctcaaggagggctgctttttatatcaaggaggctctgcagttgcctttccttttgccttgcacatccacatttttgcctccaagaagtcccaccccatttgactgtgtgcttaagatggatgcttacaaggccttttccgaaatatctccacttatccaattcatgaatttcacctccaatcaggctattcttgaagctcttggggatgctgagcaaattcacataatagattttgacataggttttggtgctcaatggtcctcgtttatgcaagagctcccaagtagcaatagaaaggcaacttctctaaagattacagcctttgcctccccatcaacccaccactcaatcgaaattggtatcatgcatgaaagtttaacacagtttgctaatgacgcgggaatacgatttgagcttgaagttattaacttggattcctttgaccccaaatcttatcccttatccaccttgaggtcatctgagtgtgaggcaattgctataaatttccctatctggtctatttcaagctgtccgtttgcatttccttcacttcttcactgcatgaagcaattatctcctaaagttgttgtatcattggaacgcggatgtgaacgtactgaactccccttaaagcatcacctcatccatgctctccagtattacgagacactcttagctagtattgatgctgctaatataactccagacattgggaaaaagatagagaggtctctcttccagcctagcattgagaacatgatcttggggcgcctccgatcctctgatcggatgccaccatggagaaacctttttgcttctgcaggattttcgcctgttgcatttagtaatatgactgaaatccaggctgaatgtgttgttaagagaactcaggtaggagggtttcacgtccagaagcgacagacgtcacttgtgctatgctggaagcagcaggagctcttgtcagctgtgacttggaggtgctgaggagcttttcttctgaagccagaagagattttcttttaacagcaactactactagaggttttgactcttcaatttgatgtctgttaaaaaatcagaattacattgctatctgtgtccctgtacaattttatgtttatgtctcattctccttatgtagtcttgactgtctaggcatgtgttccgcattaaacaaatcctaactatcgttgcggtttcataatcagtttgctatatcttcctacattttcctgtgtatcaattgctatcttttctatgttttgatacaattgctagattctaacaaatatcaaaatgatttctggaagtactgtctgatcctggattgatgaatgctaatgtcatcattcggtcgtttgcttggtaaaaattgtctgtagctgtatagtattgacctgtttctctggctggttgtgcttagtttcttgttcaaacgcaagtccgttcctaattgaacagtttttttttcttcataaaatgatggggttgtatattttcatcttgatagatatattggtagattagaaccagattagaggcatgtcctggacagcactttatgacatgtctatactctttactgtactaatcaagaaacagtattctaaacttcagattagagtgcatataagagatcaccaaggaagagtaagatagatacatggccgacaggttggtctagagtagattcctagtgaatcctgagtttgcaactcaacaacagatgtgaaaacttgttccttcaagttgaagtcaaagtcgggtggactaagatgtctaacccaaaggtcttgtcttagtaacatgatcatacgatctgaagaatctagtgtgctgattttattttatgaaggttgtagttgattaagtttctgctctgagatcagttgatgaattgattgatatgtggctcttctcagtctgcattttgttaagattatgcatgtttacgagttgcaagcttatactcctcaaagtagccacaactatctgttagtcctaacgaaaattgtcattagcgttgcttctgttctcttttgtgcaagtcacaggcaacacaactagaatttgattgctgctatgaaagaatgaattcattctttcatgcttaactcgtgagcacagagtttatcgaaaatagcctctctatcttcacgaggtaggggtaaggctaagcctgcgtttacaccaccgttcccaaacctaactagtgggattacatagttgtagtttatgcttaagaggaacaaaatggtccttacttttt

SEQ ID NO: 358 - DNA, 7407 bp, Solanum lycopersicum
ttaaaagtataaatttttgattcttaaaatattttatcatggttaaactgatcgtttttatttttacaaaaaaatgactaatgttcaggaaattatctttattatatgaaaaaagttatattaaagatcggtttagccatgataattgtttttttaccctttttgattatttcttcatcttttttgaatatccatgtttgacaatgaaaattccaaatatcatttgtatttgaaatttaaagaacacccaaaatgttgttatcacctttttatcttttcttttttctagtttatcctattttttttttaagtaatataatcctatttaaattatatttcacgtaaaaatataactaaatggaactctaacttcaattgtgaaaatatcaaataaagtgattctttttattttcatcgtcataaattaacgttcaaaatattatgtattatagaatttgtaatcacaaaataaagaactttttattaaaaaaatatagatatatataatttttttaatacgacacatcatgataatttgatatcttatttatgaattatgatttgctcatttcttcgatttataaaggaattaaaattttcatttgattattaatttccgaaatttttattcagatttattagaaaaaaatatataactcaagtattctttgtatttaaattaattcaaattttactctaaggagacacttgatcatgaatattttttttaaaacttttttttcagagttaaacttaaaaaaatacgtttcatcgtataattagagaatccaattttcaatattttaaaaaagtacttttaaaaatcaaatagaactctgattttatttatctctcaagtaaactaaattaattcaaaaaaattataatcctatataataattacattatgaaccaaatccctcctttttatttattttttaaatgtcttttttagtttttcttttatctttttggtaagtactttttgttaattttaaaatgagcctagagtttcacataggacagcaaataagcttttgttactgtctgccaaatggagggtccttagtttttttcctctctctctttctgctaccaaaaaaatagcctcactactccaccatcatcttcttcttccttcttccttcttctcttactgctgctaataagctttttcttacttgggttttctcttacaacatcaaatttacaacttcggttcccacaggtaagaaaaaattcaatctttttcttgttttttaaagctaatcttggttttttttagctaatcttgaaattttgactttggggttgtttcttctttgcatgttcttgaaattttcttgtttttggtttttgggaagtttgtggtttgggggtgatctgttctctgtttcatatgagtttgtagatctgttgagtgattctttgttttgctttttgtttaaaaaatcagattttttttttctgtttgaactgtatatacttgttgtaacttgtgaaaatgaaggatttttggtattttttttttaacttgtaggagtgaaggtaagaacttttttttgggggggtcttaggggtgttgtttttgtattaaagaactaaactttgaggtatttgggtaaagtttagtttttggttcttgtttaattattttcctgctgtttgcttttgaaatgaggaatattccttttgaaaagcttatgatctttccttttctcttctgctgaatttttctgggcaaaagtagctgctttaagagagggttttctttttctttttttttcctgctagtacattaatgtctgtatttgataaattacccaaaactaaaaaagagtttaccttgaaatctactttgctatgtattttgcttaaggttgatttcccatagtttgagttattatcttagaaagtcatcctttttcttgattttcaaaaaaatttcaacaaagaatgttatttccgagataatatcaattagttgagtgactatttgaggaatcatctatataaacaacctgtagtaatttaattcccaggattgtaggagttatgacatactaatcctgtttttttatgttaaacacctaaatgctcaatgcattctgaatggtttttttagtctaatcgaaggttgtaaattttgatcttgaatagtgttatgttaataactttgtttcttgaaatgagctgtgcaggattattagagtgatctgtaattgtgatgtctccgccgctccttggtgttggggaggaggagggccagagtaatgtaactctactggcttcttcaacttccttaggaagcatatgcataaaaggatcagctcttaaagagcgaaactatatgggtctatctgattgttcgtcggtggacagctgtaatatttccacctcatcagaggacaataatgggtgtggattaaatctcaaggcaacggagctcaggctcggtctacctggatctcagtctcccgaaagaggtgaggagacttgccctgtgagctcgacaaaggttgatgagaagctgctcttccccttgcacccttccaaagatactgctttctcggtatcgcagaaaacagtagttagtggcaacaaacgaggattttcagacgctatggatggattctcagaggtgaactatcatttctttaataaggttactcattttttggtaaagctgcaattgaagttacataatctatcctacaggggaagtttctgtcgaattccggtgtgaaagcaggtgatacaaaggagacctcacgtgtgcaaccacctaaaatgaaagatgctaatactcagagtacagttccagagaggccttctgctgtgaatgatgcctcaaaccgtgcgggcagtggtgcccctgctacaaagtgagtatctccccactaggagtaagaagtgtgatatttggataatgattgtacaaaatgtctaatctgtatcttggattaattttagggcacaggttgttggttggccacccattcgatcttttagaaagaacactctagcctctgcctcgaagaataacgaagaggttgacggaaaagctggctcaccagctctttttattaaggtcagcatggatggtgctccctatttgaggaaagtggacctcagaacctgttctgcataccaggagctatcttctgctcttgaaaaaatgttcagctgttttacaataggttagctattttggagcctttagtagctcataatttcattgattggattaaaatagtaagatacatgttcatgatttttccattgccctagttactgctacttccttgttatgacaggtcaatatggatctcatggagctcctgggaaggatatgttaagtgagagcaaattgaaggatttgcttcatggatctgagtatgtcctcacttacgaagataaggatggggactggatgcttgtcggtgatgtcccctgggagtaagctcttgctaattcaactcctttttcttttcttcccgtttagcactgtttggtatagtttactacattttcggccaacctatttcttggttgtatgctttttccattgagataaaaagaagaatatagtgcacgtggtgtggatttagtagtaaatgtggacttggtgcaactgatagtaaatacaactcatcttcagattcagaaataaaattagactagtcagtcctcatcttaaggaagttaaacaagttcttgtataactgcaagcttagagagcaatgatgctctagtaagtcctaaattaaagtggaaatctcaaacctgacccataattaggttctctgaattgagaagccttgccatgcagtaagagttcaggtaggtttggccttgtgttacaaggaagatcttttttttttgattgatagagcttttaaggagattgattataatgaagtctgattgaattaataaatcagcaagttaattttgagggccatcattactacttaccattttagaaaactcatggctcattttgtatgtgtataatgctatgtatgaaaatatttgccatggttaagcatgtagtcaggatttttatcaatcaagattcatgctgccttcagttatggattataatttcttatctctagcatgaatagaaaaaccaataataatctgattttttgataatgccaaaggattaagggatgataaacgtaactagaagaatttggtatcattgttggtttgacactcaactaggattcaatgatattgctagtgtgtgttagatagcgattgcgctgctttgggaaaaaatgcctaataatccgtgtgacattcaactcttgcttcacatgtgtcccattgttagtggtgctattccatgtaatttgcacagcttgattcagggagttagtcctctttctgtctctctctagttcgctttatctcccttcttttttgttcttttgcaatgatgaatctggtggtctactataacaatggtagacctgaacatattgttttcttgaatctgttctctcttggaccatataaaaataccagtagtacatttattaagggctgttctttgcaagttctaatatcttaggttcagacttgtaataaattttattgaatgtagtttctgtttgattgtttgtatatttgacgatgaccatgcttttaattcctaatattttcatgttgtaggatgtttatcgatacttgcaaaaggttgaggatcatgaaaggttcagatgccattggcctgggtgagtatctcttgttgagccttagacctcttcattcacacaatcaaaatgaaaaacggaaagaaagaccgtctcctccttcatctcccccgaccttgttcttagggcttgtacttctgtttttgtattttgacatgcataaccatttggcgagagatgtggggcttgctcaagtggttcagcacctccaccatcaactggtaggttgaggtttagagttcgagtcatgctggagtgttagtgggaatactagtgatcttccgggagggtagaaaaaaaggggaaaaacaactacttggtgataaatagaaatatacaaactgtaacgcagaattatctggtttcaacatttgatttctgtgaatcttgattactttctatgatttgaaacaaaacttccttgcaagtttcatatttaaaagatattattgaagaaataattagaagtcatgaaatgctggtttaggaattctcccacccagctgttcgtcatgaaagttctctgaattaccgtgatgcattttttcaagtagcgttaagtattagagaattgcttgcctgacagaactacatttgttatggatctggcctcattttattatttgtcaagcggcaatagaaagatttaggacatcaaggtaggctaggcatcttgaaatggtggtggtaggttcatttgcattgtaggacacacctgcatctgtgagagatgaggatggagagtgaaggagaatggttaatgtagtcccaaaaccgaaaggaaacgagctataagttattgtaaatctatgggcagtgttatgcagttattgctgttttaaacatgtgagttagtcagctttatctcattataaaagggcaaaggggataacaaactcagctgttataatttccgcaaaagttctgttacccaataatgcatttccatatgctgatttgtgtgcagacttcggataggtcttttattaatctgtaagtgtgtttagtctatggtaatgcaactctagtttaatttttggtattggttgcaacatttcaacgaccaactcctgctcctaaggtatgaatgattacctacgaaacggaaacatgttacaattccactaacttctgtgcatttttatgtgcagccccaagggctatggaaaagtgtcggagcagaaattagcctatctacacatgattaaagctatccatccagcatttctagtaggcgaggaagacacaaaaacgggtgaagagctcataaacttgaatcctttttaaaggcatgaacagtatagctggttgttggtcttggatagctcagcatgggtagatgctttacctgattacgacatggtgttcttttatatttgcgtaatatatgtcctcttttaagttttttttatcatgtctatttaaaaaaccgtttgatattggagtttgtctgcaaactaatgtgtgttgtgtactgagagctcttctagaggtaatttagtaatgttctaagtgtatttgcttgtttaagttcccttaagtgtgtactttagacccaacgtttgtcgtttgattaagtatgcgtgtgcacttcagaaattgttattactgtatgaataaatgtgtcctccacatttttcatcgggttgtagttatcgaaataactaacctcttacctcacattgcatcaatgtcgaatttagcttcataaactatgaactctgttccacatgctcaattatttgttcataacagctggtaacattattgtgtctgtttagagttgttgtgtagactaccttgcctcaattatttgtgtattaacatcagatcttcttgtctattgccttctcatttcgcgtttgttgatataattattcatggcttgcattattgaaagtctattccaggtgaattattagtattatgaaactgcatgattggtactccctccgtttcaattcaagtgtttgtacgtctgactaggtacggagtttaagaacctaagcgagaattttgaattttgtggtattaaacttgtcacgcaacttgaatatgtacatataacaggttggaagaaaggacaatatttgtggtaggggttgtggaagttcattgtacataaatgtgtttttgtatctcatgttttctcatctgacacttgaaatgaaagatttgtttttcaatgcactgttttgtgcctctttgagatgccaacagctgaattagtatttatcatttgtacttatttcactgtgcaaaagattgggagaatcttgggttaaatgggatttttgtacaccaccttaatatttcatatgacataattaaaactttggaatatgtgtttcattgcttaataataacatatttagctgtgaaatgatggattaattagtatcatatgaaagaattaatgaaagtgtttgcacgtttacttgattaaatactaattcagctgttagcatctcaaaaagacacctacttttgaaaatttatttattttggagtactcctttcctccttaaccaagaagtcgggatcaaatccccttgagtaggagtcgcctttatttggtagcactttacctctgatgtgggtctttttggtgcgaatttgaatttagctaggctccaatgtgtttactgagcgttggtcgggtgaaaatcaaagaaatctg

SEQ ID NO: 359 - DNA, 4806 bp, Solanum lycopersicum
ttatttatcttattttggcttagtatggatcgacattcaaataaataattcaatcttttgtaattatatagtaaaaatgtgttaaatatcatttattttatgattgtaattttgtcatgtgaaaacataaagttaaaaaataaaactttttctatcctattttatgtgatattttttattttcgagagtcaaatattttaattttgatcggatatttgcgtatgaaaattttaatttgtttgaagttaaatctatatatatgtaaacttcgtaaagaggactataagtcacaataattgataattcaaaatgttaaaaggatctatgaaaaacttacatcgaaatgcgaaaaatatcagagatggagagaataattataatttttttaaacaataattgcaagacaaataaataaaaatggagaaaatataattatttttcatatcactttatatgatatttctattttatatttaatgagatgattaaaacaacacaaatataatatcttagactataaattggaggagaagctaaaagtttgaatataatttgttaaaagttaaatttattatttttaaactgcgtgctgaaagtacaaacacattaatatgataacatttggacaatcttatttacatcaaacatatgttatatgctatttttgtccttgcttatcgtttaaaatgagattaataaatatttaataataaagttgactgacaactcattcttaaaagtccccttttcatacattattattataacataataaaattacataattaataataaagaaaaaatgtcctcttgtgactaaaatatacacacatcaaacgtttaaattttccttatttcagacatgctgcagcaataatgttgtcgacataaatgaaattaaataattcaaatttttttttcaagataatagtttataactttatattataataaaatttatataagtagggtaaccatttggggtcagttaacatcaggtttgttatgtttttctcttgtcaaaacacacatacaaaagcgcacacaaacacaaacacaaaacacaaaacacaataacaaaatccctcaaaagagtcagagaagaagcaaaggggaaaaaggggttgtgaaaaaatagaggtttttgaggttttctgttgggagaagaaaaaaaacacactttttatctgtttcttgatatatagagaagtagtaaaggttgtttcttttatctcattttcttcttcaagaatgttgtaaagatcaaatctttatgctacaaaactcacatgtcatcattgatatcatctttttgttcttgtttttgttgttgttgttctcttatggggtgctagctacttcaatggggttgttttcttgatacacaaaaagtagtaaaaattgttcctttatctcattttcttgaatttttgtccaagaatgttgtaaagattatatctttatgcaccaaaagtctcatgtcatcatcatcatcatcttcttgttcttgttgagttgtttttcttctatagttgctagctacttcaatggggttgttttcttgatatagaaaagagtggtcaagtttcttccttcacctcattttcttgaatttttgttcaagaatgttgtaaagatcaaatctttatgcacaaaaagtctcatgtcatcaacatcatcatcttgttcttgttctcctatgggtacttcaatggggatgttttttgctgatatgaattcactctctattaacactccagaaagtcttgatgaaggtaaagggagaaggggttcttgggattttcaattcttgaataaaggggggtcctttttttcttctcgtagtcttgatgaagcccaaaatagtgaagaaaataatgagtctattgatcttaatgcttcttgtttcaatgatgagaaacaaattacaatgcatactacttttaacagtaacaataatagtagtagtagtggctgtaatggcaaggaaacagagaatggacagtcaaaactttgtgctagaggtcattggagaccagctgaagatgctaagcttaaagaacttgttgctatttatggccctcagaattggaaccttattgctgaaaagttagaaggaaggtcaggtaagaaataaaaatctaatctttttcaagattctactagattatcgaaaatagtccctctatctttattagataggataaggtctgcgtaaacgctatcctgaaaaatcacatctttttaaagattctaactcggaaacaacctttcttatactccacttatgtgattacattaactatgtttgatgttatttcatcactccacttgtgtgattacattgactatgttagatgttgtatatatcattttcaagatttataatgactccttgtgatataattttcttattttgatgtgtaaaggaaaaagttgtagattgagatggtttaaccagttggatccaagaatcaacagaagggcatttagtgaagaggaagaggaaagattaatggctgctcatagattgtatggtaacaaatgggcaatgatagcaagactatttccagggagaacagacaatgcagtgaagaaccattggcatgtaataatggccagaaaatatagagaacaatcaagtgcttataggagaagaaaaatgggacaatttgtttacagaagatcaacaacaacagtagttgaagaagcagataattcaagtggccaaaattctgttaaccactttagtatgaaaatgaataataataatggtccaaatggttgggttgtttatggaccaaatggctcaccccacatggctgcttctgctggagaagcagcaactcctagtagcaccaataatgtgcctctctattctccatactcaccatttgctgctcccccttttgactcattacctgcaggtatatatgtgtctttcacttacattaaattcctcccactttttggatcatatttggttcaactataaaaaaaagatgcaagtttcttgaagtttgaagtcataaaaagtgagtcttgaagttgaagttgtgtttgaacatgcatcttagtgaataaaaatccaaactttattaaaacttccaaagattatatacctatgttgctcaaaaatgtagacaggtgtgtgttggatgttctaaaaaatgtgcgtgttgaatctttcgaaagtaatatatttttgaaagattcaacacgggtgcgtatgactttatatttgaagagtcagagcaacataaacttgaaaacaatagacaaaattgtgtatctaaaactttgtttttttttaatggttagttatgaatgttgttttttcttgaaggtcattgtgggaatgagatgataaatgttctaaaccaacaaggaggcagatcttgggataggcaaagggaagttactcatcaacatccatctaattcattaatgatgatgaataatatgcaacaagatcaatcacaatatgtcttgcagtttccttatgttacacaaatttcatcatcaccatcaacaacagaacaaggactagtaaaagaggacaaaagaagcaacaacaacagtgataataccacaattgcaccaccatttatagactttcttggagtaggagccacttgaataattcaaatcttcttctttttttatttttcaagaaaaaggcccccctcccctccccttttgaaacaatattagtagagcatgtaacaagtattttagtttttctcattctgttattatgtgtcaatttgtgacactgaaatatcaaaaagcattaaaaaaaaaaactccactttgcaaactgttaacaataaggtgttgtcacttctttgcctttttttactcatttgttttagtagtgagatcaaatagtgtgaccacaataaaattcataattttttggtcattgaaattcaattttaaggtggggggtgggggtggggtgtacaaagcaagaaaagtggggaaattggagacatccttttctcatgaggctgccaaaaaaacaggcagaaattcaggggtcctgaacaacaaaaactttatgtaagttgctattttatgcaatcaattatggtaactgctaaacatacatttgcctcagcagaatctttatgtcaccaacatgagagtgcttatttggagctgttccaacagttcaatacaagacaattcctcacccaacccccctcatcatacacaaaatatatactatgtatgtgaattcggatttagtcagaaaaaaaaatcatatataccataagtagcgaagttaagcgtttcgttaaaggtatattaggtaagatatatacatagtctttaagaatagacacaaaattataaaaataattaagtacacctataattttcttttgaagtttattgccttaaaatatgtcaaattttcagtaattatgatatcttctaagtaaggtggaatgcatagtaaaatatctaaggtgaaaagtaaaaattaaagtattttttaaaaaagctacttttatctgtttatttgatgtgacaatttcttagtccgtcctaataaaagagaacggagtgaaagacattatccttttaactttaaaatacttattctgttcttagtgatataatttttcaacttcataaatatataaaaattgtttgagacaataaattttaaaagtctgtcttttttcttaaacatcgtaccaactctaatgattctacataaaatgaaacagacgaatgacattacgttaaaaacggactaaacagaaaagtaagacaaataaattaccgcgatat

SEQ ID NO: 360 - DNA, 3087 bp, Solanum lycopersicum
  modified_base (3048)..(3087): a, c, t, g, unknown or other
ataacaaattcaaagatgaatactttgaataatagttttgtttttgtttttataaacttatctttacttttaagtcttgctcgtgatatttttattattatttgacggaaccatcgacaatccttcaagttgtcatcaattttcacttagatttaaacacctcaagtaggaagtcactgtgtcattttaacaccttttcgttcatcaactgaaattacaaagtgtataatacactagcggatgacatgtcatgatgactaattaaaagtttacatatgacatttaagtgtaaaaataataattttaaaatcaataacgaaaagcaattaatttttcagtaaaaataaataaataaaattacctattttttactattccatctcaccccaccctactaattcaccttacttctgtcccttttgcctccccaacctcccgccaaattttgggtgttcttccattttttcttttaaaaaaattcattagatatttttttttttgtgaatttgattttgagaaccatatatggcatttcttcttccatttttttgggggaaaaatgtgtttttttttcaaaattagtgtgataattttgttcttataattgtttttaaaattagtgcgataattattttattttactttttcatatctttaaaggtttttatcaaaatgcgtacagcacacacaatacgccgagtcagcaaaaagtgtcaaactgacataacggaatatgatatgagatgtctagaatgaacaaaatatagttaagatatctaagtgaaaatgtatgtcaactttaaatggccaccgatgaattagcccttattattttactcgttatctaatatccatattaaacacgtctttttcattttaaaaaaaaaatgatacatttttttttcatacctaacacacctttgcctatcttttaacaactgtttttttagactttggctgtgctattctcttataaatagagtctaaatattttttacaagaactcattaactctcaagtttgacaaaatggccaccccttctcttcaatccccaatagccaaaaagttattttctttctttttcctaattcatagttttaattttttctacacacttagaaaataatagtactaatttctattcgaacttattttttatgcaggctagaaggtaagatagcaattataactggtggtgctagtggcataggactagctacagctagactttttattcaacatggtgcaaaagtaacaattgcagatattcaggacgaccttgtaaattcattagtaaaagaaaatgaacacctaatgttcgtccattgtgatgtcgcgattgaatcagacgttcaaaatgtggttgatgcaacggttgccaaatttggtaagcttgacataatgttcagtaacgctggtgtagctggtaagtcgatttccagtattttagacgtagataccgatataattaaaaacgtgttcgatgtaaatgtcgttggggcatttttatgcgcgaaacatgctgctagagtgatgatttcgagtcatacaaaaggttcaattattttcacgacaagtgcggcaacggtagtatatggtatcgtcccacattcttatgcggcatcaaaaagtgcggttttagggctctgtaaaaacatcggagtcgaattaggaagatacggaataaaagttaattgcgtttctcctcattatataagcacaaaacttgcgttggacgcgctcggaatagacgagagagaaaaggcagagagatggtttggtgaaggggggaatttgaaaggagttttattggaggaacaagatgtagcaaatggagtgttgtatttggcaagcgatgattccaaatatgtgagtggtttgaatttagttattgatggtggttatagtactacaaatgtggctttgggtgaggcctacaagaaattgttcccttctggtacaaccaatcaagttatgcagattcttatttaaatttgtgagacatttaatctggtccgttttgtattgttttctagccttataattgtcactgtcttactttatgtacacgctcttttcttttttcaattctaataattatcattgtttttataatgtactcgatttggagtattacattaccgttgaataattttcttaaactccattggcttcattaatacgagttcggagcctaaaaggtacaaaatattaacaaaaatttcaaaacggtatataaaattttatattaatcataatggtaaaatcgttgcaccaacagcgacttaccccccatcggaaaaagcaaaattgctgcctctgcagcgattttgcaaaatctgattttttttaaaaataaaaaataaaattgctgctcctgcagcgatttcgtaatttttttttaaaaaaaaaaattgaaaaaaaattctataaatcactgcttagacatcgatttcatttttttaaaaagaaaaaaaattagattttgcaaaatcgctgcctctgcagcgattttgctttttccggtgaggtaagtcgctgttggtgcagcgattttacccgtttggttaatataaaattttatatactgttttgaaatttttattaacattttgtatcctttagacttcgaactctcattaatactactgtatcgcggaatatcaatataaaatcttaaaatatcaaatcatatcaaattaattaaattgctgtaatgatatatatttttaaagtcaaaagacatgaattattgagcttaaagttttcaatatcatatcatgccctaccctacttataaatataatgatacgagtaaagtgtggaacaagagtgatcattcgaatatcatcaattgattgtgagccattaatgtgggttcaacttgaccctactaagagagttaatacctcatgctcactcaactatgcactcttccctcagaaagtcattcaattttcaattttccctcaaaagtcattcaactatgtacttctttctcagaaagtcactcaactatccattctttcctcaaaaagtcactcaannnnnnnnnnnnnnnnnnnnnnnnnnnnnnnnnnnnnnnn

SEQ ID NO: 361 - DNA, 2629 bp, Solanum lycopersicum
cgaatttcaatataagtatcgaacattaaatgaaaaatctgaataaataggtcaaatttagtcgactttttagtttggtgaagaaggctaaaaaggaaaaaagatgtgttgcaaggtgaaaaatattgttcttcatttttacgaagagattcaggttttgaatttccttgaataaaaatatatttttatttttttgaggaagcgatttgccatcaaatataaaaattttaaaaacaaattcaaatttaatcgaatcgaaattttattttttttagccaacacttagttagaccgacaagagagtgtaatgctgcctttagtggaggtgacaaccctttgattcctttactgatttttgcagtttttttgtctctctattatttaaaatattatgaaaaaaatccatcaattttcttcacctattcaatatttctaaaacttttaattttttaattagaaaaaaaaaagatttacatttttatatggtcaaggttaataattttatctactatcattaattaatacatcttaatatattgttaatatgaagttttttcctattaattacaaaatggttgaattaaacaaatttaaagttaaaagcgacagtgtttatacttacctctgattaatttacgcggacagaaaaaaagtgtaacaaacaaaaattgttaaaataaaagtatcataaaattaatagttaaattaatcatgaaaaatctacaatattataagtttcttcctctggatcgaatacgtaatattctttattataagatccataataataattttatacaatgagtatataaaattagtaaatttttagctcttcttataattcacgacatgcccttcttaatttttttctctctctctattatacacacaaatacacttaatattttccctatatatacatttggcccccctatacttcccacaaacctaatttcaactcaccaatttcacaacaacaaaaaaaaaaccctacctttttcttgttcttgttcttgttcttgttcttcttgataatcgtcgtcttatccttcttcgaaattgaaatttttagtcatgagttatgaaccaaacacggccttaaacctaagtctatcaagaaatgatcttttatttgaccaatcatcatcatcatcatcatcaacccctttaagcccggttgagccacgtgttttttcttgcaattattgtagaagaaagttttatagttcacaagctctaggaggacaccagaatgctcataaactcgaaagaaccctagccaagaagagtagggagttgagttcaaccctacgcgggcctcattctagttggtcaaatcatagtaatagtaataataatagtaatagtaataatcattgctcgttgagccctagtggtccgagccatactagtcatggtcatggtcatggtgctaggtttgttacaaataatgatttaataagctatggaagaagagagatgatgatgagttatgaatcaatgaaaaatggtcatgagagtgttcaagaggattttggacatcttgatttgtcattaaggctttaatcatcatcacttttttttttaaaaaaaaaataattttggttatttgttttttacttcaagatattgttgtaattttaacctattttgatgtggttaattaattaaagattctactcaagggcgattatgttcttattaaattaaatatgaatcatatttagttgttgtttttttgtatagatatataagagaattcttctgaaattgtgataaaaaaaaatctagtatatattgactttttggtatgttgaataaaattgttgatatttaatactatatgttatagttgtatgataaatttgttttaattaatatgtattgttctcttcttgccatcctatttctatttgttaggatacattttatcatttcactcgtggaattcttctaagtaatcataatgtagttttaaagtataaaaactaaagatttgtgatttcaaggagcaaaattatagactaagagtactcgtaatattatgtactttttctaattttctattcagattttgatacttatattagagtataaataaatttaaatttgctcaaaaacatctcatattaagtaataataaatcgactcgtataacaaataaggctcgaacctaaaaagttaagtagtcctcttcaccacccaagcaatagtaacataggccaaaaaacatcacaaaaacaatcaaatgaaagagtattttatgccaaaatatcacaagttgatatttatctatagttttgatcatcaattctaagttgttcaattaaaaattaaatggataccgattgtctgacattttcgttttttaagagtcaaacagtttaagtttgactaaaattttgtgcatagattcttcaattttttttttggaaataaaatttatatatttgtaaagtacgtaaaaaaaaaatactataaatcacaataattaaaagatacataaaaatttacggtcaaagataaagttatttcaatctcaaaattcaaaaaatatcacgtaaatcgagagacttttttcttaatctccgaatatatcaaagtgaggagtcggtaacatgatcttatt

SEQ ID NO: 362 - DNA, 4267 bp, Solanum lycopersicum
tggacagcaattcctgtttaagggttaattgtatagggacatacattttcttctaatagtccagggtagtttggttttcgatatgtggaaaattatctcgacataaaatgctacagtaactaattagtacaatatttagtttgtatttaccattacatttagctccacattcacataaattggtagtacaacatttaatcttctaatttgtactataacattttcattaataaaaagtatggtttctatcttcaccattagcgtaacgttcgagtagagatatacatatttattattataatatacgattgcaaatgccaaagatggctaattttgttttgagagactactgcattaagtaaattttttcagagacatgtataagattaagtctattgccaattctcaaatattactcttttttacttattgtggttatttatacatattaagtgaactttcttttaagacaaaaatgtgaaagaaatgaatttcaaatttgattcaattccataaaatagctcaaatcggaggaggaattaatattcaagtcttataaggaaattattcatcgatcatgattatttttccatgttaaattgattaaatcttttttcattcttcaacatatctaatcttctaccctacaacaagctctcacctttcatagtatttatatagactatatattcgtataaaatatttttcttcatatcgaacacacatgatctttttaggatagagggagtattttttaaaaaaaaaataatggggcaaacgcaaataaaatagaacacatatatattctttctctagctgctaattaagctatgactttataattttgtagcacgagaagagaataacctttttgtgcttttcatttctttaatttggttccccattttttgaactatcaatattttagtccctatcccatctgactctctaatgatcttagggccactataaatattggtattttgctcttcttttctccaccaaaaaacaactacaactctttaagtagattttgttttgtttcttataattaattaataattaactctaaatatatatatggcttccaaaatgtgtgaaccccttgtgattggtagagtgattggtgaagttgttgattatttctgtccaagtgttaagatgtctgttgtttataacaacaacaaacatgtctataatggacatgaattctttccttcctcagtaacttctaaacctagggttgaagttcatggtggtgatctcagatccttcttcacactggtatatattaatcttcaacacttccaatttactccgtctgtctgtcctaatttatgtcacacattttctatgatatatagttttagaaattattcaagaccataactttttaaagaaaaaatcatagactttcttagtcaacgtcaaataaattgagacggacaagatgacatgattagtacatttatcttctattattgacctctcattttcttttatacattatttgacagatcatgatagatccagatgttcttggtcctagtgatccatatctcagggaacatctacactggtatagacaacatatgccttaaaactaactcagtcaattttatcttcaattgtttactttggaaggggaaatgacatgatcattatatcatagtacaaattattatgtaatttctgttcgtctaaaaaatgtcactttagaaaaaactgataatcatatacaataccacaataaagatagaagaacatgtactaatattgaacttaaataatgagtactaggagtattattaattaactttaaaaatgctagtcaatatacctatgtttatatgttaaaaaatcctttatatttggaaacatgagtactcctataccatacaatgttgtcgtacagttgattagacgggcaaattaaacaaatgtccaataattgtactaattaataactacttgttctcttcatctattattagttattaccaaaaaaagaggactgcaaaatggtgatattattatgtgtaacggaaaaaaacgtactctatttaatatgatagaatcaaagtgacatattttgttctagttagacaaataagtaactgaaaagaggatttgaccatctttacaggattgtcacagacattccaggcactacagattgctcttttggtatgtatccttaacccataaatcaaaataatgtactttctttttatttgccattaatatctctagtacaaaaaagaaatattataaaaaaaattaatttcaatttttatattataggtttaagataataatattaaacgatattttagtctctaccaaatagacgagcaaattaaaactaagaaagcactacatgttttctttatattattagtataaaaatatattataatttgcctggtggtaataggatcaaagtattgattcttaattattattatataattaataataatggtaaacaaaaagatataaagtgcttacctcctaattccctatatgaaaaaatatacttacttaattactctttttacacgtaagcatgcatttaaaaaaatattaaaaaattattccagaggttatatataatatgtatggataaaaaaaaaattcacctatatacataataatataattttcgagtgaattgaccgcccttcagcatcattatataatgttatcgatctaggtctttgtgtgaaattaaaagttatttatacggttagtacgatcgcgtaataacgaaggtaaaaatatttcaggaagagaagtggttgggtatgaaatgccaaggccaaatattggaatccacaggtttgtatttttgctgtttaagcagaagaaaaggcaaacaatatcgagtgcaccagtgtccagagatcaatttagtagtagaaaattttcagaagaaaatgaacttggctcaccagttgctgctgttttcttcaattgtcagagggaaactgccgctagaaggcgttgatatatcgacaaattaaaagcatctacaattatataataattagtgcgtggacggactactactactatatgcttttttaatattatataatttaataagacatgcagacttaaattttatattatgtatgtatatgggggttaatggttgttcaccctcatgacttaatgccaatggcttaattataagcacaatgtaatgtaatatcatcaatgtttcacttaattaatataattctatgtgtgttttctcatgtagtaactactactactactgcatgtttttcttctctttatatttacgtttaggtcaactttttcgcatctttattaagataaaattaggcaactagtcactttttggaatacaaatcaacattcacaactattcaatttttatccctagatagacacaaaactctacgaagtcttgcacaatttaagcttcgatgagctagagttttttcgtattttataacatggatattattgtttcaaatatgatttcagtagtataaagtaattattacttcttaattacatgttaagtgaaataaatacaaacaagcagtcttaattaatactgcacatatctaagacaattttttaccttaaatttgacgggagatcatgatttttctatcgtccgaaaaaatttgatattttgaaatatgtatttttcttgatcaagacttgtgatacaataagatcatatctatttttcagtttaccaactacaaattcttaaaattattgttactagtattatatatcgtggggttacttactactaattatttacgattatcaattaatgttacttcttaaaatcttaaatagagtgacttgaaataaaattttaagataaaactcattaagttattaatagcaaattggaatagaaggtttaaacattgattaaaaattttatggattaaactcaatctgttccgcgttgcctagggagtgagcttatgttccttggctttataatttctgatttattgatataaatgttacacaatcatatgactttatttagttattttttataaatatgttaaactaaatccgaaaactctcgaaatgacatgttcagattttcttttttgactgcgtagagtcaagtgcagcctaggtctcgtagttcatttgtttccacaaattcctccagatttgattctcttttcctatttatgactattcctcccaggtactacagattctctatcacaaactttattaattgtacccacac

SEQ ID NO: 363 - DNA, 3126 bp, Solanum lycopersicum
tcacatgatgttaatattactactttttaatcaaatccacaaataaaattatctttatattatttattaagttctttttcaagtaaaagtataaatatctaaatagaaatattaacataattattttgagtttggactctctttaattttaaaatttaatattatatcatatattttaattaatttttactggcccataggctgaccctatcgatatttctcaagcccccaaatcaattgatttattcaggtccggctaaaaaatccttttctaaaatgggttcaaaaaatcgtagcccacccctattcaatccagggctaggccaggccgacccaacaggcctaacccatattgacggctctagtaataatgaagatccattgtaaaaaaggtaaaaagttaaaactaatttgtaaaggctataaaagcaaatctccaattgtatacaaagtagcatgatctattaaagttcgaatcttagtagctcagttgattgattattaatgaaagtttgaattccatcttataatctcctctcccattttcccctacctccacccccgaggcaaaaagctagatgagttatagtgttgatgcaaatcttaagaaaagatgatttctagtttaggcccaacagaaagtattgagtaccaaatgttcttcctagtattgggttgagcccactctatatcgtttgggcaactttgttaagcacccaatttgtatgggctcttttcattcaggcgttattataattgggctgcctttctaccaacaaagctaatttacttttttattttatttctatcaactttttctttttcttccttttcatcgcatttataatagcagaaaacacgtgtccgctgagacaagtcaccattaacatgacgtggaaattttctaaacacgtgtactctctttgtccatttcaacaaatttgcttcagtcacatgaaaaaagaaatataaattgatcagttttacaaatcaatcaattaatggcaaatatggaaacttcggcgaggtcggtagatcctctagtggtcggaaaggtgatcggagatgttttggacatgtttgttccggtggttgactttacggtggagtatgcttccaaacaaatatcgaataatggagttgaaattaagccagcagaagctgcacaaaagcctagagttcatataaagggttctcttcattctaataatctttacacccttgtaagattaattatttattatttgtactatttcaaaagtcatctaagagcaatcataaaattagagtttttttttttttagaaaattaaatatgcaaattgagtgtctttttcaagaattttaatatttggtccactgtattttacaggttatggctgatccagatgctcctagtccaagtgaaccgacttttagagaatggctccattggtacgtactctattcattgttgtttcattttctccttcaattagcctgcatacgtcttttatttaattttaaaactttatatttaagtaccaataaagtagtttcgatatgattatgctactatctctttcaggattgtcacggatattcctgagggaggtgatgcctctcaaggtattaattgagataactattattaattgtacccttttttaagtttctagatgcagggtagctaccaagttgttattactattatcgcacatggtctttttgtcgatgcatatacgagttgtttgttcacttggtgcagggagggagatggtggaatatatgggaccgaagccaccggcagggatacatcgatacgtgttcactctgtttaggcagaaggaggcggagcaagtgccccataaaccaccacaagggcgatccaatttcaagactcgacagtttgcaagtgacaatggacttgatcttcctgtggctgcactgtactttaattcacaaaaggaacatgctgctcatcactagctctttacaatgtgtgctgctatatatagcaatgtaattactaccttatgcttgttagctagtattgcaagtgctttgcatatatagagttatgtatacttgtgtttatgtgaggtgcattatatttataagaatatgtgcatgtgctgtttgatatcatgacttgattctgcgttgacataatttcttgtgttcaacaatcttaacgtgcagtgcttcacacaggaggcaacaatgcagaggatgtagaaacaaactagcatatgtatcgaactttgagaaacttatttatgttattcgttaaaagtttggttcatctatgtcatcattgtttcagaaatagttcattcattaccattatttttctaacagataatggtacggatgagcttttctcaaacaaaaatggaacagatgaatcaaatttttaacgaaggaaataaacaagtcttctgaaaattcaattacatatttgagtttttttccaattttgacacctaaagttctctccagagaaaaaaacctggttacaaccagagttgccttaatgttgtggtggaatcaatacttcttcattctttggcagacgtttcaaattcgagtctccccttctttcctttattagagagtgttttacctacctctcaatatgacactagatatgagactttctagcatggattctgatttactttggcttgcctatcaaagcatgtagaatgcagtattaaatagtagcatatgtttacattgcctttttatgagttaaatctgtcactgagtagatctatgagttacaccttaatggttctaacatatatacacataagtaaatctttgccaagtgacaaagatcttaagcaatcagtatccagtcatccctcctttgtcataaaaaagaactagattctactccctagcagtatgtaagcacgaacctgcaaagtctacgagatctgcatcaaatcagttttgtctatcatctttcaagaggactgtttgctatgcgtgaggttgcgaatttctgcaattgcattcttcatcccacagataaccattttcttcacctgtttgttaaattataacagttacattaatggatgttaagaagatagcgtaaacgtaaatgaacattacacctattttggatttaactaaa

SEQ ID NO: 364 - DNA, 3974 bp, Solanum lycopersicum
ttacatttttgacgtatctttattttgtttattaaactctatatatagtcattcataaaaatgataatatgacgcataaatcattccatattttattaaattataattaagatttgaaaaaagaatttacttcttcaaaatataatctaaatagtctatcgtaatataaatattaatgttatctagtgaagtatgatttaatgaagtgtaaagttaacttacatatgacctagagaaatcacttaagtagcgatgaataatccaagaatatgtttggtcctttattctttcttgtcatggctcatgtatccatgcactttattataacaattcgagaagtgttataattatggtgattctcttatttaaaattttttgaactattaataaagtaaatgaataataataataataatatgaattaggaaaatatttatgtatataatttttatgtcaaaattacttgattctccactttacagctcaacaattaacatatatggtttccccttaaagaaaaacttcaaaaagattcctatgatggtaaagaaacgtttggccataaaaattaaatatttttcaattttcaaatcgaaatttttttgatcactatggatctgatataaacagtctccctattacgaaaaagtaagagtaaggtctgcatacatcttatcctctttaaacctcacagtttgaagatgcgactttgtttgattatactttttccaaaggagagaattaagagattatatttggaattacgcagacaaaatttgaaagacatcttataagtttgaaatccaattacaagtggaatttaaaattttcacgacttgtcaaccattgattctcaaataaagtgaaaaattattccaaaaacaaataaatattttttttatgaccaaatatgtcctcaagaacatatgaaagctctctagtcatgagtataaataacaagggctagctagctcttgtctactcataaaatatcatccatccatctcatgtaataaacaaaaattgagcttattaattataattgagaagaaaaaaaatcatgcctagagatcctttaatagtttctggagttgttggagatgttgttgatccattcacaagatgtgtagactttggtgtggtttacaacaatagggtggtctataatggatgttccttgaggccttcacaagttgtcaatcaacctagggttgacattgatggagacgatcttcgtactttttacactctggtataaactcatcgttttatttcatatgatatacatatatatatatatatatatatatatatatatatatattttctttctatttatacattttaatatctctaaattattaaccttttgtcaattgattatgagtagaagatcaaaaggacaatatgtgcaaaggcttctaattatgtgaatttgtgttagttttaattttgattcaccatctaagtacttgttttgtggtttttatttgaatttgagaactcataacatactatttatgataataaaaaatgttagtaacatgtatgtttaatattgcaagcttgaaaatatacaatatttttaaattactaataatgtcatgtaatacatttggatatacaatatggaaaattatttttcctaattttcaaaatatttgaaatgtttcttttctttttggaagattatggtggatcctgatgctccaaaccctagcaacccaaacctgagggaatatttgcactggtaagtcatctagcttatattatatatatatatatatatatatatatatattatataaatagataaaaatattcattttgttatatacttcttatttctcttaaatcaatcgtcgatagcgaagacaaaaatgtatgtgagattatataagaacctaaggaaagtattatttcataaaatgataactttctgatacacaaattaatcaatatttcaaataaataccaaatatcgaataacaacgtaaaaaaataataactattatcgattgcttaatccccttacaattaatgtacctaaacctctttttttttttaaaaaaaaaataataataataatgtttaacacattatttttttaataggttggtcacagatatcccagcagccacaggagcaacctttggtaagtttttcttacattattacctaatggctcgtaattacgcagtgacgaagcaagaaatttaaatatactttatatttacgatacattgtatccgtatcactacatttttaatataagacggttagtaatatacaaaatacaacttgtatcatcatcaccttagtagtacattattagtactataggcccaattatgactactaataaaataagacttaaaaagaaacataaaatcaaaatgaagtatatactatgtatataaatgtttttgaaacaaggaaaatacgcgtattgaatgtctttgttactaaactcaaactctcgttatacaggcaatgaagtcgtgggctacgagagcccacgaccctcaatgggaatccatcgttatattttcgtgttgtatcgacaattgggctgcgatgccatcgatgcaccggacataatcgattctagacaaaatttcaacacaagagactttgctaggtttcacaatctaggtttgcctgttgctgctgtttacttcaattgcaatagggaaggtggtaccggtggtcgtcgcctataaatcacccccctctcctcggggtgcgatccgttctcgaactctgtgtcaatgtcagatgttttgtgtaacggattttttgtttgatagtcactcagctaaattgcttattaactcagaaagtcatttttctttttatcgaagaaaattgaaattatgagataatagctattatagttgagtgataatctgaaaaaaaaaatcaaccataatatatattatatattatatatatacccaaaaaataaaagtcttgtttggtatatattgatatatatgtatatgtgttttatattttattactgaattttaatttgtatgtatacgagtctacatgtaaaagtgtggatatatttactatatctatttgataaaagagtttgggtttcttattgtagaattattataattcaattttttttgccttaaaatacgagacacaattcattctatcacaattcatattaattaaggatgcagacttctatatcattctatcacaattcatattaatcctaataattttttgtttgataatcaatttaactatttatggagccctttaacttattgagtctaaaaataatacattatatgttcattgtagatcgaattatttccaaagtaatttgagatgaaaagtgttaagttcatcttgtcttatatttgttagcaattttactttaaaatatacattttatttttaatgagataatttatagtcgtcacattaatctatggcatattttagatcatattttttttaaaaaaaaactttttaatactcgatagtgaatcaaacaacatattctgtgaaatcgtactaaaatgaggtaatttagaaaagattgagtgtacataacccttaccaatacctcgctaagttagagaggttgttctcgaaagacccttgactcaagcaaattaaaacagtaattaaataaaaacaatagtggaggaaacatgtcaactaatagcgagtcaatgcagaattaatatatatacaaagaaatcgtaaacaacatggtacgatcacctaagcacaataaatcataaatgatccgtatcgaatccaacaccatcacttaaattatgacgatgaaataactaaaaatacatatacaagaccgtaacaacaacaccaacaagataacaattacctaaacactataaatcatagataatctgtatcgaatcaaacaacgtcatttaaattaatacaataaaaataactaaaatatatataacaacaat

SEQ ID NO: 365 - DNA, 5008 bp, Solanum lycopersicum
ggagagatgtggcccttcaaaaactagcggaccaaagtagtgcaacatgagctccagggagaagacgaatatgagccagacaaaccatacaatcagaatttgtggcaaaggtatgaagctcaacgaggttaaggaactcgtcagttgagtcacaagatgtggtttcatcaattaatgtatattccctttcatgtttttacacgtctgtaaaatcacaaagataaactatcaatctgagtatgtgtcacaactcacaaaatcatgtattatatgtatcaccattactgtatgaaaggcggtaactggatgcaaactatatgtattcacatttggaatgtgttacaaattctagctcatatattgtatcatacattttacagttctaacatataatttggttttcatttttcttgaaatatatgtagatatgtttgcagatatacgctgatctgcctatggttaaaagtggccagtgcaaaccacctaattagcatatacgtattaatcgtaaataattaaaatagcgtcagtaccaacaaatacataatttcagaaatgataagtcacaagagttgcatcccaaatattgtttcaatgagttaaaatcgcactgaaagttgaagatttttttatataaataaacaagtgttgtaatcgcctatcattagtaaagtaggttaaaatcacgaaggattaaaattcacatatattgaactttactaagtatatgataatgaatagagtaatcaagttgcatataggcttagacatttatttacctatatataaaaagaactatacaaaattattacatcaaacatacaaaatgaacgatagaggggataattttagacgaatatttttttttgagttaccatttagattttatatatatatatatatatatatttaaaaaaaacacaatgaagtgactggtaaatatgaaatgtgtccccacacaatccaaaggcttaacaatggatagctaacaacagttggtgtcagtttcagaatttcttgtttttctgattctgatgatagcaaaatccatagctaaactaaacattgaaagaaaagggaggaaatgttaacagcaccttcactttcccgctttaagtctccatttatcagctcacctcttaagcttcctactctttcttcttcttttttcactcagaaatttcatcaaacatgtcgtaggcgaaattcgtacccatgtattaaagctgtggatcttgatcaaaacacggttcttttctttctcaagttctctttttgtgtttttctccatgattattgtttaatttcagttgatctcatatgggttttttttattttttttttatttttggggaaattgtgatgtacttggcaggtgatagcaattacagttggggtgctcagtgttgctattggagttggaattccagttttttatgagacccaaattgataatgctgtaagttttaagatttaattttatgaaatatgctcttttttgtacctttcttgattatccgggatgctacttacgggttctgcagagctcagttgcttggtacaactacagtttttgttacatttcatttctcgagagtcgtttgactaattttctaagctaaagtatataagattaatttgatattttaaaattaactatgtttgatatataactctgttttcctggtcattttattgcttgacaattcctgcgatatatatctccgttttcatagttaaagaatgtacattttgtaggcaaaaagagagaacactcagccctgcttcccctgcactggcactggtgctcgtaagtatttcttaaactagactttccattctgttgtttctttatatgttcgatccgataagtacaaatgagcctagaggtatattgttatgtccacaagtgtacttaaaatacataattggtggatggcactcaattaagaaatttgagctgaatggctgccaaagagccgcagaattgtatttcggcttaattaaactatattgagacaattgcaataagtgagagtttcctgtttgcctttgaacccccagaacagtttcttttgaaaatatttactggaagccagtagttcttgttgttgaaggagtgcatacattggttcaacaacaacaaaagtagagcccgtgttgttgtatttctgatttccaggtaaagttttatttgccgtttgcagtgagatatgggagaatatagattgtagaataagggcagaagtttcaatatcctcaagataaaactatgaagtacatgttctgatttgtgcttggcttcagttttagatgctgtagtactttctgatggtttttggcccatgaagaacattcatcaatccttgttatcactcgattctttcttacaagtctcaggaaaataactcttatggttccttcctatattccagtttaagacataacttgcactttgctacgaatctagtcatttgcttgccagccaagagaaactagactatggtttgagctatccacatctctttatattagtgatgtttttgcttgtatgcgtcatttatcaacttccgtaagtccgagcaaagacactaaacccacatgtcaattgcttccatggatcttaagttgacttattgaaatggtctagttttgtatcacttaaaattgacatgtatgacttgttgatcaaaatatctgacatgatggatagagcaaattgtgcatttcttagaaatccttccaaaatgctcatagtatggatctaggatttattttttaatcacttaattcgtatgccacttcaaagatgtcattgtaggttgacgcctatcccttagcatgtctctagtgcctttaaggaatttctggttgcagctacttacatcaatgaccaattaccaatgagcttctagaaaatccatggctccgatccaacaattttattcaacttgcaatttactcctggcttgacttaaatttctccttctcatagataccgcctttgtaattgggaagtgttctaatcctggccctaaggtggttctatctgctgtggtgtttttgatcatcgaagagagcgacgaagagaagggtgatttatgatttgacgtttttgtttttctaaaatttgctaggtgaataatcttgaagtttccactttaaatatcaaagtgaatcttcgttgtcatgtgccatcaattaagattgcatgtatagacattacatcacccagtaaaagaggagaattgagttattgaaccatacaatcttactgaggttcgattattcaaaaagtagtcagtagattgtctgatcaaagactgtagagccagttaatccttaaaacctaacattttttgagactgacttagagctaatacttatgaagggcttatattgcagagaaatgcagattttgcatgggtactggcagtgtgacggtggagcttggagggggtgagacagaagtctctcggtgcatcaattgtgacggtgctggtggtttgacttgcacaacatgtcaaggcagtggcattcaacctcggtaccttgatcgcaggtgagttatcattctttacacctcttactactacacacacaaaaagaaaacatagaatcgcgacttctgtttgcattttgtatgataaggagaagttagaactcattcttggagagacaaatactgagagtgtcatcttcttctcgacagggaattcaaggacgatgattagatatggaagaatactcagcatggatgccacaacttgtttattgtctagaagacctgtcattttgacctgaatatattgacacaaaattgtgtaaaattcatttatgttcatcccctctctctgcctttctcagttttcacatattcctttcaccttctgttcttacatgtaatctttaacaagttgagcaatacatgatttcaataccagctttgtccaattgctagatgttgtaaatgaaattgagcacctgtgtgtattgcattttaaaaaaatctttttgttaacgtattataaaaataaaattggagatgaattctcttccttctctcaaatttaatttaagttatatatatcgatggtcattgggtcatccagacgatatatacatgtatgattttacattggataggatttaaaatcttgaaactaagataggttatttgctataacaggtaaatgttagttgacaaattggtacgatattattatttaaaaaaaaaacacccaactaagataggctataggttatgaaggtaaatatgagttgatggattgacacgatatcatattgatcaaaaaaataaaaccgtcgacagcagggttcgaacctgcgcgggcgaagcccaacagatttcaagtctgtctccttaaccactcggacatatcgacttttgttctgcatcctacaaatagttcaataagtatatatatttcaagttacaagttttcactagggtttaaattcatcgtctccctcgttccaactggaaaaaagaactgtttcctctgtatctcgtactggaacttgtaaatttgcatcactaattagaagtatattttggattagaagtgaagtgaagtgaagggagaatcatgctgtatataataggtcttggattgggtgatgataaagatataactttgaaaggtcttgaagcagtaaaaaaatgcagcaaagtatacatggaagcttacacttcacttctctcttttgggctttctccaaatggtctttccaatctggttagaaaaaagctaccgtcttttcttgtaattttgttttcagttagtgaaaaaaaagagagtgattttgatgataaagttttgatcttttttcaggaaaatctttatggaagatcaataacacttgcagatagggaaatggtagaggagaaagctgatgagatccttaatgaagctaaagcttctgacgtggcttttctagttgttggtgatccttttgggtattcttcatttttttgatatgctta

SEQ ID NO: 366 - DNA, 3688 bp, Solanum lycopersicum
tgatttaaaaaatgtatttaaatttaaaataaaaaattatttttgatttttaacttattttatgtcatttttaatcctgcgaaatattttctaacttagttcaagttatttttatatttgtcaaacgcttttagaagttagaaataactcaaaaatagatttgaataacttttaatctaatccaaatacaaatactcgataactcgttcgtcagtactgttgaatacttagactcctgttaaattcaatttgctattttccctgtaagattcttttagcagagaaaaataataaattcaatttgcaattttctttgtaagattcttttaacagagaaaaataattaaagtttgaagaaataattatattaattagttttgtgcaaagaccttttttttaatgtatcacatattacttttctgatctaattagaaaccagctcaataattagtgatcataaatagataatcaataaacaatttaaattatatatacttaccgagtaaaatatttttatactattacatcatactgtcatgtgttccttattaaatattacaaagaagggctaatatgtaaatatctttgaataattatatcgttaatacacatcttaattaaattaataaataaaatatttaaaaattatatatgctcaattgtaaattactttttacacgtcaacaacaaaaatatttagcaaaatactacaagacaaatttgggaagaagatagtgtatgaataccttatcattaactcgtgaagttattttaaaaattctagactcaatttcatcaaaattcaaatgtaataaaacccaatataaacaccatagaaactaacaaatcattccaaaaaaaaaaaattaaaaaaaatctacatgtacctgagatttaaataaaaattattactttaaactcaaataaaagaaacttaaaccaccagaaataactgttaatttataattgtactatatatatcactttccctggtcagattaaaaaaagaaattaaaaaaaaaaaataatcacatattatgtgtgtataaaagacaacaagatcagtaacagataaaaacaccatagctagccagaccatgttctgttgcatttctcatctgtagtctctctggtgttttttctctgcaccaaaaacacctttcttactgcctcttccccaccccaccaactcacaaaatttcaactactgttccattgaaaatggctacttctcttcagttttcttcagatcatcaccctattcctcaggaaaatcatcaaacaacgaaccagacctcaacgggaggacgtagaaggtcgagtaaaaatggacagaagaagaagaagcaaccacaaagaggaatgggagttgaacaactcgaacgtcttcgagtacaagatcagatgaaaaacagtactatccatggcgttcatcataatcatcagtactactctaataacaatttccctaaattaactcctgtttcatcatttaccggcggtggtagtgctagtgctgatcctggaaattatagtaattctattttgaactcttcaccagtacttcagttccccaaattgtgtgcagtgagccctaatgatttttttatgcaacaaaaagttgtgaatactgggtttattggatctagtagtacaaatcagttgatgatttcttctcatgatcatcatcagtttcaatctcagatgaatctctacggatttgcaacttctaagcccagtactgagaaatcaaaggagctgtatccaatgccaaatctgtttagcagcaacaactcttgtttctccgatcgctgccgatcatgcaacaaagtatgagtatataaaacgcaaatggttctccttccatttttttaaatttaatttataattttgctaatttattcacattttccttcttcgttatcataagaagaaacgcatgatcaatggagaagaaattagcgttcatatggaggacatgatcagagaaaaggaagattctggaacaaagcctttgcttcactcatacagtttacctagccatcaacaaaaggtaaaacaaaaataaaattgcactagctagccctaatgttattcaattgttcgcttcgaaaaactgaaaactaagtgatttgtagggcgtagagattgtggcaatccatagaaagggaagttcatccgcgttgtcatccgatgaaggagcagtaatgatggagtatgatttttttccagaaaaaatcagcagcaaaagcactaatacttacaaaagttgtttcgagaatgaagcaacgatgatgagtgcttataattcaccagaatcttcttcatttgctgctgcagcagcagcagctggaaatattattaatggtgaagcttcttctgttactacaatatcttgggctgcagatactactactacttcacctaccagttccattgatctttcactgaagctttcttgttagttttttttttctacagaatcatttgaaaaagtatatggtttaatttctctgaattttgtcttttcacacttgtgtgaaaatttatctgatgaaaaacccaaacactactttatttttaccattttggtttatctgaattagctagtactacttgttattacttctccaaaatggagcaatacattttctgggtttttattgtatctatatctctttctctctactcttgggattgtgtgtcagtgagatgtagatgcttcactattttttttctttctagatcttatatttatttaagagttcatgatcaattgtttcaaattatgcgggacggattgaaaacaacaacatagactaaaattagtttagatgtataataacgtaagctgatccgaagatcacgattataatatagtataaataacatatccaaaacctatcttttctagaatctaaaatctataaactccttcctgtctctatgtcttaatctgttgcaagtccagtggaagcataatctaccaaaaccctagcaagctagtatttattatggtggggtgggggtgtaattaaacaaggggggtaggtaattaatattcacaaaagagagagcttgtatattttccttaaaaggggtagccactaattaaaccaaaaggaatacaatagaagagtatctctttatgggagtcaagcataatatactgatcagacactaaaaaaacaaaagaaaaaaagtgctttatggcagtctagaagtgagtatagatgtaaattattttactttttattattcaaaattatttttgatatcacatgaactgagacagacgaaaaaagataggcaggcttaatgagagtgtaaaaagtgagtgttcaaaaaaggaatgggaaagaggcaataataggtattcagtaaaccgtatatatgtaatccatgaaagtagtcagtagtgttagtgtatatatgagcttcaactggtggctcattgtagtagtagatcgatgtggctatttgcagcctgcatgctagctagctgctttaatttgtggctctgcttcaagtaccctcatgcatgtaatgagtgttaatatgcagtgagactctcagtaaaaacttagggctactcaaccttttttttattacttgcttgatgttcgatattcatattgaatttcataagattttaatatttcaattaattaacaatatgaacttcaat

SEQ ID NO: 367 - DNA, 5515 bp, Solanum lycopersicum
aagaaatttttttaatcttatggttctaaatcaaagttgtgtcaaatgtatcaaaatgcgttttaatcttgtggtctttttcatatcacgtggaaagttaaaattaaaatgttactgaaaaaagaaaagggtcattcttttttaaacagactaaaaaatgaaataaaattattctttttaaaacgaaggggataataaacaataacaacaagaagtaaaatgtcgcaaattacccaacatgttgcacaaaaatctgttcaattaatgttctcttcatgacttaattcttattaaagatggatagctttgatagaaagcgttttatccctgacattttaagatgagacttttcgatacgaatctagatttaatcagatcctaacacgggtacgattcacaggttaaatcagtaaataaattcaaagcagaaagagacatttgaaaaggtcaattcacagttaggaaaatgacagttagaaaataaggacagagggccctttaataagaagtatatgatgttaaaagagacttcccacaagtcacctccaaaagtagttaaaaataatagaaagttgaaacatcaattcttttttcccttttaataaccgcgatgttcaagtcagctttcgcgcgcctcaacttataattccaagaaatatctgtcattggaatcgcttactatttttgaatttccaaaaatagatcaaaataactggggatattatgtgatttattagtattctaaatcttagtttctttcgcgtgccgtaccttaggattcgtgctattgctaggtaactctgtccatcaagaccgaaacaaatgagaaaaatcacctagtgtatttttttgtctccgcaactgttgtctaaaggtaccttttttcactcttcaatatatttcatatactccacggcacatggtgtggttctcaaagcataagtgaggtcagtgtttcttactggatataaatagacataaatttggggagaaaatgaaaccacatggaacaacaaaacaacactattattattattattcaagaatcactagcaagactggttaattaatgttaccaaattttgcatgtccttcaaattgatcatttttagtcaccctttcctacaattgcactaggtatgtgttttaaattttgtgattactcatattattaatatatgattccaagattgtaagctcatttagccatcacatgaacaattttgctgatgtaagacaattgttgttttctgctgttatagtaggttaaagaatagactaatgaaacccctctcgtgagatagtttttggagttgaggtagacttagataccttatagtttacatggtatcagagttacgttgatccgagctcctagtccatggtcttagagtggattagagtcttacatggacttgggaaatccttccctcacgctccaatttgcttatattacgcgagatgctagctgtcctattgaggcagtttttgtttttatattgtagctctgcagcattttgttgtatatggaatagaaatgcctctgaaatacttttctatatctgtttgattgctgaaggactattgaatgggaaagcgaagaaactggtttacctttgtcaagagacttttcattcctgaaacagaatcaacagcagatcaaaaggtttgaatttcaagatttctgttgcttagtagtgtgagtgaatcttcggatatctaaactggaaatttatgaaaaatatttcagaaaccaaagagatggagatgttgttttctgagaaagttcaagttgaggaaatgtcctgctataacatcagcacctcagcaaacgttacctgaggcgaaaggaacacctcagcaaacgttaactgaggcgaaagaacagcaaagaaaacatgcttttgcagttgctatagcaacggcagcagctgctgaggctgctgtagctgctgctaatgctgctgctgatgttattcgtctaacagatgctccaagtgaattcaaaaggaaacgcaaacaagctgctattagaatccaaagtgcttatcgcgctcacctggtaaaacatcctctctggtagctctagtactttcactcatacaatttcactgtgaacttgttgcagagacgcttttaaatgcagaaagattgaaaattagttagtcattcaagacaaaacttaaaggatagtatgggaaaaggtaggccagtttggatatagcaggattaaacgcccagtgctctaccagctgagctacacacctaaaaaatgataatcaagtaaacaagtattgatacagaaaaaaggcctgcccctttactctcatcttattaaaggagcacgactatttattatgaggcttgtactacagagcaagtggaagctccgaaggtcacacttttttttttttttgccttttggctgttaatcatattagtcataaggtagtctatcacctcggttggaaagaaaatcttattggttggaaaatccctctccgctagtaaaactcttctcttatggcggctactaattctttttcctttcatctctcaaaaaaactttccgagatttggtgaaatgaactggtgtctgatctatgtccctgtgaaatgttgtgcaggcccagaaagcattaagggctctaaagggtgttgtgaagcttcaagcagtgattagaggtgaaattgtgagaggaagactcattgccaaactgaagttcatgttgccacttcatcaaaagtcaaaaacaagagttaatcaaattagagtccctacttttgaagatcatcatgacaagaaactcatcaatagtccaagggaaattatgaaagctaaagaactaaaggtaagatcaatcattcattctcttttgtttaattaagtttccaaacattagttcaactatactaaatctataaaagagacctactaacacatcttattatgacttttatggtttggaactgtaatatggttttttgtttttttggcagcttaaatgcaagagccttagcacttggaatttcaacttagcttcagaacaagacagtgaagccttgtggtcaagaagagaagaagccattgacaaaagagagcatttgatgaaatactcgttttcacatcgggtaaagtcattacttgttatacagacactgcaattacacttgtcaatgtattataaaatgttgtagcagttaacctgccttattttctagaatactaatctcacattttatgaacgattatttataatatatttttaggtaagctgatagtatattgcttcttttaggagagaagaaacgatcaaactctacaagacttactaaacagaaagcaaaacagaagaagctacaggattgaccagttagtagaacttgacgcaccaagaaaagcagggttgttagagaaattgagatcatttacagactcaaatgttcctctaactgatatggatggaatgacacagcttcaagtgagaaaaatgcatagatcagattgtatagaggacctacattctccttcttcacttccaagaagatcattttctaatgcaaaacgaaaatcaaacgttgatgataactcattaccaagttctcctatatttcctacttacatggcagccacagaatctgcaaaggcaaaaacaaggtcaaacagcacagcgaagcaacacctaaggttacacgagacattgtcaggtcaacattctccttataacctcaagatttcttcttggagattgtctaatggtgaaatgtatgacagcgccagaacaagcagaacttctagcagttatatgttaatatagaaggtgttttacaaggattgaagaacatgagtgttgtacattattactatctttgataacgaagtgtccaagccggtttgctctcacctctgctagttcaccgagtgttgttaacttctacaagtaccagtaccagtactaggtaactctgttcaccaaagatgaatgtgtacattatcaacctgtttatgcaagcaagggagcgcagaaactcctagatttgcagcattacttctggacatgaaaacaatcagaaaaatggagctattattggagcttcaaacttcttcagtaatctatctacagttgattgatgaaagattactggttttaacacttttttatatagacttgccacaatgtgtatatatagttcaagtttttttccctttccctgtttgttttcccttgtttcatttatttattgatttgtaaagttgtttccatgagaccaggaggtcacaggggtaagattctgtacaatagaccatatggtctcgagccttcaccagaccgcacatagcggggagcttagtgcactgggctgttgttctttttttttttttgcttctgagttgatatactggaggaagaattgttgtttgatggccattcacctggaagcatttccaagtttggtaattgcatagaggtttaatctttgccttctgtatttacataggtttatttcttttgatttcttccttcaaagttcaaaccacctctttattatttcatgtaaaatccttcaaaaaaaaatgaacttacaccaaaatttatgtcttacctttcttacaaaaccattgatgttgaaactaaggaaaatggattggaccaaccatatgtagaagaaatatagcaagtttactccaactttcactacttatgttaacacattgaacacttgagaaacaaaatccattggaagctcctcatttctacaggcttaaaatgtctatggtatatccaatgtaacagaataacacatgtgaggcacactgttctcctcaactgagattgacagatttcacatactacaaatttgtaaacttttggaacataacgcaataggcaagataatgacatttgacaagaagtatcaactgtaatgctcaaattaccagataagtgaatgagatagtcggaaatgtctgatccacgacgataaaatctataccagtaaaagtagccctcctgtatgttttgaactaatgataacattcagtccagcaacaactctgctgacctcaaatctagaagccaaataaaattacttgaccatgaggcagaaagaagattcacaaaattctagaaggacaaagcatttgctggaatcatcactcgcaaaggccaaagttggaagatttgtatgtccattgtccaccttcaagagaaattgtgtctccagtatatgtgtgcctcgcaaacagtagaagagggaagtctataagcaggctatttgggtagcttggtttgaggttgcagatgcctgattgaggaaataaactcccatttgcttcttttcatgaagatggctttacttcaaagggacgtcgcacgatagtgttgcagaaggaggcaacacaaatcttggtgttgatttaaaccagaaaatgactatctaatcagttttcttttctccgttattgttcatgaatagctgatctcttaaagtttcaactatcttagctaaaatg

SEQ ID NO: 368 - DNA, 11840 bp, Solanum lycopersicum
  modified_base (3182)..(3617): a, c, t, g, unknown or other
tacaacaatattactcaatttccattagttgtcacttttcaaaagagactctcattgtcccttttccccatacttatagaaaaatggataattaaatggagtttgatcaaactatacacctaaaattttacaccctccttttgctacttccattgagtaccacttacctacatttccataaaaaatagaatataaaaaatatactctttgtctcaaataaattatcatgattttctttttatacgttcaaatttcatttgtgaatttatatatttttttttgatttttcattcggtgtcccatacctgcatagaagtttgattatttcagatttcgcgatgcataggcaccatttcgagaggggggaaggttccctacaatgaattttttcatactagggctcagatttcagacctctgtttaatggatgagcaaccccatccgctgtacatcatcctttggtggtggatctaccgactacactaattaattttaaaaacaaagttttttttatcacaaatcagtgagaaatttatgctataaaacatgatttcccacaaaactagctttacgtgtaaaatacatgatgaaaatactaaattttcactgtaatagtgaaaaacttcttaatatttccatatgaaatgattattattttttcttttgtcactgattcaattaaaatatctacaaaaataatcactgaatatctttcaatgagaaatttagtgcaagaataatgattttctagtagtataactaagtatattgttgttgtttttcatttacacgtctcttaagaaacattaattaatagaaatattgaactattttaccctttataatatcacgataactaatttgagacgaagaatagtttagtagtgtatagatatacactcaaaaagtagtatattttagttggacggtccaattttttcctatctataactatcctccagcttgttcaactcacttccattttctgcaagctctcctgttcaaacctatacaaaataggaacaaatttgaagagaaaaaaataaaaaaaaatctctaaggtagattttctttctttctttctatacccaatctttgctatatcgccatttttttcttaattttaataatgaaaattgttgttttttcttcttttggatgctacaaacacatacacaaaaatatttttaatttttttttgttagactataatttccctgattgagtgtgtaatttagctaacgagatcgcgatatttgttttgcttttttcagttttttttttcttcttttcgatacaagacgatatggtttttcctattaatcaggaattacttgtcgatgagtcgtcttctcagttgagaaaaacaagtggaggaactggtggaggaggtagagggaagattgaaattaaaaggatcgaaaatacgacaaatcgacaagttacgttctgcaagcgtagaaatgggctattgaaaaaagcttatgaactttctgttctttgtgatgctgaagtttcactaattgtattttccagccgcggccgtctctatgaatatgccaataacaggtttgtttatttaattctttttttctctaacaagatctgtttttaaccctaatgaaaaaaaaaaatgtgattctgcagatctttgccttttgtgtatgtttttttttgatttgggtatttttgtaatcggggattgcttagatgataagcactcttaagattatgagttcgtgtcaatataggagctcgtaacgattgatctatgtcagtctagatatatttgtgtgttaaaaagagggtgactatggtgtttatttaagttaaaagattgagtttcttccatcacaaagatttgcttgtctaatccataatttttttttgtttcctttctttatgagcttcaaaaacaccaaattttcctttgattctacaaatagatccgttgatttgagtcgagaaatcggttattaatattggttctaaacttgtttggagtacgattctttctagaattttgattaaacagagatattttgtgtgtcgactatctagatatagattcttatcggtataatacatatattggatcctaaacgtggctttaattttaactttgatctccaactttcataatgcagcacattaataatccaatttttttttaaaataaacacatgagtcctacatgaaacaatacacgtaagacaccatgtaggacaaaaaatgacttgtaggacatgtgtgtctatttgttcaactttatacaaatttaagtatttatttgtatacattcaaaattaaagaatataaatgtaattcgaaaaatcttgataaatttacaagtagggttaaagagagatagggaaaaatcttaagcttacaaaatttatttccccttttctctctgtctctatttttttttgggcatctttgcagctagtaaatttttctctctcttcccaattttttttgtttgtctgtaagctgtcaagttctgatttattttcaatcaactcttccaattgatgcttccttaatatatataacatgtcatttcagacatcacacaagcaatagcctatcagattacagattagggtttcaggtacaccaaaagagtcaagttgctttttctttttcaaagttaggattttttttttctttggtgaagcgaagggatcgaactctcagtaataaagtgaaagttaagatagttctttggaaaaaaagagaaactttttcaactcgtcataattgaattaggattatttttacaagcaaagcaatttctttctgactagagggagttactcagttggtaaacattcttcactttcaattttaatattgttttgcctttgtttttaccattatagcctttcaataacagagatagaaattttttgtttctaggttatatatatatatatatatatccaaaattttaaacacaaaaacaaactttaagtaaaagaattactaaattttatcgaacccatttgtatctcctctcaccctccttactttgtaattgaggtaaggacaaatagtccccttctctttgatttggtgatatatataattttatcaaatatataaggctcaattaaaattattgaattctaataaactcataccatttctttagaattcagtaattttaattgagcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagaattcagtaattttaattgagccttatatatttgataaaactaccccgttgtctcaatttatgcaaagaggctcaaaatacaatagttcaaatatttatttttaattaaattatgaattaaagtatatattttttaaaatatacaaaatataaatcaacatattgaatattcaaaatatttaacaaattagtttgagaaaattacactaaaaagaaaaaatctgtcaaactctcctagttataacaccttcgtataaaatgggatagaaaaaatataaataattaatttcaaactcaatataaatcaaataagtgatagtcaaaagtcgaaaagttagaaaggcatgatgtagaacttatttaacttccaatttcatggtagtcaaaaattatttatttatttctaaaataattttttaataatttcttgaaatgtggggttgaaatataggggttagggtttcatgtgattatgagtataatacatcatataatagggagttagacaagcatatttggtcacgtcacatacgaatttttcagttttgagctaaacaacaacaatattttgtcatatattttttttctcgacggttcaaaaatatcaaattttcctggggtttccaacaagccaaactttcaacgaattttgtcaaaaaaattcaattggaaatgtacactttatgcaattatgatatagtgtcacgcaaattaaaattaaaattctttaggtatttgatatttcctccttacttacatatctcttgggttctagctcaaccttgtcaactttgacattgaatctaatgcttattacctaatctagttctataagagtttgattttttatatggtcattaaactaataattgttatcttaaaaatcacctctcttttttattttgagatacttcttccatttcaatttgtttgtcttattaaaacttgttacggagtttaagaaagtaaaaaagaataatttaaatcttgtaattttaaattacagatatgtcaaatgtaccaaaagtagatttttacttttaacctactaagaaaagataactgttattttcctatttatcctcaatattagttcctaactattcttcaaaattgtttcttaaaattaaagactatacatcaattaatatgatatgagtactatgaaaatgtattcatattaattattgtttttccagaggcatacaaaatataaaataaataaaaataattatattaataattaattaagtgattatatgagaaattaagtggtagcagtaaagagttacatttatgaagacctagtcaaactaaaagcttattaattaatttttggtatcctattttttcaccatttcttggtgaattttagtagagagggagtacggaaaaaaaagagtcactgcactttcctttcttacatagggaagaatgacttttgactgtctgcaattttttcgtcgaaaattatatcgtataaataaattagtacataagttgttgaatctcttttaattttagtgttaaagaatgttttaagttatgaattttgaattatagaataatataacatttcattgagtagagaatagattttatgtatatatgctaatgtgaatttcttcaacataaatacatgatttaggctaatgctatcaaacacctaattgatattgtagattcctacctttaggagtttaggggtgggttagattttaggtattatatttttttaaaaaaattcatatataaatttctgattccgtcattattgaggtggatttagggcataagcaggtttatgaaaatcgaatacctcttgtacatatctattaaaaaaatcattccgaaatcataatttgaactcattattattattatatatattttttatttttatctttacgatttattattatataaatcttcttttcaattgtctgttttacttcttttttcttgtttgtttcttaaagaatgtctcttttcttattttgacaaatattttaacttgaacttttcgttttcatatgatatgtttaaaatcataagataaataatttgtgataaaataacgagatcacaaatcaaaatcagacaaataaattgtagaatttatttttgggatgtttgcggggataaaagggttttcgttgggggtattattcaatgggtaaaattaagaaacattgtagccaatcatgttgttggatcttgagccaacgtggcagggaacaaccaatcactagctcgatgaaattaaggttacataatgcttcaattcttcttactgtaagtgcagaaaggattacttgttcatccttttaacccagaggataaaagaagactcacaaatcacatttgatgcgacattgtttgacttaacatgatgtttaagaaaaaaaaaagattattcttttaaattttgtggtttaaaaacattattttgtagttataaattatttttatcaagagtgaaaggaattttgaaattgaattatttctacatagtagggacagatttaataagaaatgtgccacataatatagagagtataatctttaggtagaaagaatttaacttttgattttgactttttgagaggaatgtacaaccgtcaaaaatactctttgaattttttagttctaaaagtatggaaacataacattcttttaaacaaatattaaaaagttttaaaaaatcacttcaccttgactttttacctagatcaaaatcagtttcaggctatccaaactttttgaaaggttattacttgtaattataatagtctatgttattcggatttatcaaaaatatagacggataagtaagattctttaaaagtaaagcatttttagtgattccgacatagatgcggcaacatttattttgtcgtaggcgtccacatctaaaagattgacaagacattttgtgtagttttttttttttcttttgattaaaaaagttaaatttatttatatgtaatatgcatccatacaagacctgtggcctgaagcattacattcaaaagaaatatttactaagttataaacatagttcatacatactatctgataataaggttaaaaattgctctttcctcgtctgcattgacgattttcaaaacgaatacaggattgctcttgtttgtatcatcatcatcatcaacaatttctccgtcttttggattgcaattccacattctaggtcgaaaatacatagaattgtgacatctgaaaaatgatttgttttgtatttgtgtgtatttgcagtgttagggcaactattgataggtacaagaaacaccatgctgattccactagtactggatctgtttctgaagctaacactcaggtaaacttgtttatataaatcattatttttagatgtaatttttttatatttaatcgtccacctagggttttacctctcgtgcatcaaagcaaaagactaaacaaaaatatctttagcactatctatatcaaggattttttaacctcgcggttagctcaagattcgacacataggccgtgggctcgtggcttcccttcttaatgaggatagaggctaaggccgaggttgagtcaaaacagataataacatgaaatttgggggctaggatgttaaaataggtaataaagtttgtacctttatgatggggcaaacctcaacaaagacctgtttctaaaaaggaggatggggagggaagtgttacaacctacaaacaattactaattgttgaactctattgttgagacgtcttttcatttaaaccttagacaaaatcgtgaggtttaaaagccttaattaaaaacataaaaaatacttaactagttgacctagaccattccacttacattttgttttagtatcaatcgcacagagaactagattttttctaatcatcacaaaaatgattaaattgactcaaacttttatatattcctcagtactaccagcaagaagcatccaaactgcgacgacaaattcgagatatacagacttataacaggtcagtccaaagtggacttctctaatataaatcattgtgtactatcagaaaatcactaatttttattgaatttttttgttggaatttaacagaatatggaatgtcgaaaattagagattttctagtagtgaccaaagttgtagtaattatgattttttgttttgtttaggcaaatagttggagaggcattgggcagtttaagccctagagacctcaagaatttggaagggaaacttgaaaaggccattggtagagtccgttccaaaaaggtaaataattcaactttttgttagctgattttcactgttttcttcttattattacaaaggtaaaaaactgacatttttttattttatcattttccagaatgaattgcttttctcagaaatagagctcatgcaaaagagggtaaaactactaatttatgtgctttccttaattatatatttataatcatgatgttcaggtcagtttgcgtgcacttaaattaattttacaagatatctgctacctttcactagcaataaattacctagtagttttgcctcatctgtattcgaacatgaaacatcatgaacttaatattcagttttattaatcagtaaaccacccccttaaatgcaaaatatagacgacatacttcaatcaactttacgtttagatgagtcaagataaattgagctaataaataaatagatcattaattaacttatccaaattttataaattttattttcatgaactaatcttatcacttgacaggagattgagctgcagaacgccaacatgtatctacgcgcaaaggtcctattattttctctatgcctttatgttacgataggactctactagtatctggacgtttgaccatgttacattgtgaaatttttttttaaaaaaatttttgtttttaaaattgaaaatgatatttcaaaattgaaattgtgtttgaccatgtcaaattaaagttgttttctactttgtgtgagtgatttggagtgaatagtcaaaaacacattttcgttgtttttcaaattcttgaattcaactatgacgaaacgtgctttttcagagttcaactccggaaaaattgaaaatttttcatgatcaaacgcctccttgatcattttaacttgaaaattaatccttgaaatgtacatatgtagcagatagcagaggtagagagagcacaagagcaaatgaacttgatgcctggaggcggaggcggaggcggaggcggaggaggaggaggatctgatcatcaataccatcatcagccaaattacgaagatgctcgcaataacttcctgcctgtaaatctcctggaaccaaatcctcattactctcgtcgcgacaatggtgaccaaactcctctccagcttgtgtatgcctctcttccttcttaattataattttgtaatttattagttagactcacatgagtgataaattttactaaaaacttattaaggttttaagtatggattgagattttataccatgaaacaaaaacttgtcatggaaggggaggtgtgaacgtttagctcccgataatagagagttgttcagatggtaaatattccttactttcaattctaaagatgagttatcaagagagcaaaacgggtggaagctctctgaggaggggtagaaaaaaaaggaaattttaccttttagtacaattagaatatgaaactcgagaaaaaataatagttgaaatatgtttttttttttgactattttctctaaaacttcaattagtggagtctttgttatatcaaagctgggataaactaatcccataatagctttgatagtccaaaaaacctggaacttcattttaggtttatagaattgtttttggtgttcttaccaaaaccagggtcaaagctacaactttgcccacagatttggtaaaatctaataattttggctcaaatcatatatttgtgtttaaaagtttaaactaaaatgtattcaataatttgttgaggacccagtaaacaacagattatgcctcactaaaaattactttatgtgaagacggtgattcattatgtgcttttaacctaactcaagccaaaaaaaatatttattcaatagtcaccacttgccacttttgctcccaaatctttctggttgttcttttcaaaaaacattggttacatctttttacgtcattcattaccaataaccagtttatagatgagtgttcttgaagtagtcagtctagatctgaacctacatgctaagtagatgacttgctaggcgagcggagcggaacctaagatttcttgtaaatattttcagtcaatccacccattgccttaatgttttgtgtccaatgctcaaaactttcttactttttgtcttcatttatatgtgttgtaaagagattgtcagaatcttaaagaaagacaagaaactttgtcaaatctaagaagaactaagtctatggtcaggggaagattaactgatgggagtttgcggaacacaataacattagcgtgaatttcgtatttgtgttaagaaattcacttaatagacataaataatcttatgtagaacaaagtgatccaaaattcattactttagctagcgtttggctataaattttggatcaaattttaagaaaattccactttcactactagaaataaaagggttttttccattgcaaatcaatcgaaaatttgtgttacaaaatatgatttttccaccaaagcagttcattgtgaaaacacacggtggagaaacaaattgtcacggaaatattatgaaacttcctaacttttccttgcgaaaacattactgttttttattttcgttcaatcaaaatatatgtggaaatagctactgaaaagtgattcttagtagtgcttaattacttcaattatttttaactgattatttctccatttttgtcttggctggttttatttatgcagctgataatcatggagcaggtattctgaaatttggggtcaaggctcttcatcttcagaaaaatgtgtactacaatttttaacctatagtgttgtaaatcataatcataattattgccactgagatttaaactgtttatttttaagcaatattattcagtcatctgttaattaaggaatgaaaaatcttgtttgttatattatgactacttctatatacttttacagccttatataaataatatgctattgaactatacatacaacattctctagctagctattttgttaatttcttttatctttatatcatagtagtatataaatgtttagaaaataagaatgatgttcaaacatttatgagaataattgacatatgtttgaaatacttttcagaaattcttgaagaacttgtgaaatatcttggataaaatatttagagaactttgatctgtagctgcttagtctcatcacgcgttgtttcactcactagaaggctatataaacagcagatatacaagtcagtgaatgtcatctcccaaatcaaaactaaaaaacagtattatgtatatttttagagcattgatttagttcatcctacaagaagaagaagaaataagcttacattcagtagaaatttcggaataagttcctataaacacacaagatattgaaaaggaataaccaaatcagattgcacttgaccttcattagaagcgttttctgtcttgagttgttgacgatcatctacccatgatatcattatttttcataaccatagatgaaattaagctacatatggtctcaatatagagaagaatagagtattcaaagagtaaaactaaggtattgttatatatatatatatatatatatttaaggaaacatacgtggaaaattacttttacaatacctatacctatataaacctattgcatctcgaagattgtcaaacagtatctaatctgagtagtatatggcatgctagcttctcgtctatacagggagactactgtgtggtctgattggagactgaaggctgtaccttcttccctccaactcagaatatatatcgaggctaaattctgatacatttcacgttgagagtgagactttgtccccttaattgttcactccatgattccacatttcctaatgaattcacttgacatatttacatggcggctccacaagcttcgtatctcaggggccccaatctcaagccatggcttggctggtccactgaaatgtacaact

SEQ ID NO: 369 - DNA, 3748 bp, Solanum lycopersicum
ccaatgctctttaactttttttttcaaattagtgtcacctaaactgaaaagcgataaaaaattacttataaaataagttcagagataataaaaccttaatatagtataagtgtctatgaaatttcaaacataaattaagagggtactcgtaaattttgcataaattttttgaatttgttgtgcgacttgactatttcaaagtcgccatcttcagataaatgtgtgccaaagtccaattttgtttgggttctgaagtttgaataaacatgttataattacttctaatttgtaaatacttcaacatgtgtttaattcaatgcatgttattgaccttgtgggatttttcttaaaactcaaatatatatagctcccaaatacctattaacctataattccctatagactcaccctaaataatccatatgagtaccacaaattaaattaataattaagctagctccttatccataaatatgtatatagtcaacttaggttaaaaatattcgaacttgatatagcaatatatctacctaatctatttttgacttggttcctaatttatttgcaagcatttggctatctagatgtgtcgatatgatcaatggtgattgattatttagaattacattaattccataaatgtaatgatattttgccaaatattggacatgagttagttggactttagttttaattttggagtaaatgggaagaggaaggtaatgcaaaacgttatttttcaatgtttataatacaactagctagggtgccaaccattgcctactccatgtgattgtatatcttatctcaaattttattttcccaaatcccaaatatgaagaaaattaacctaactttcgttgaaatctaaaattaattagcaacaactttaattcactcaccctataaatatccctttaaacaacttcaattcctcatcacctccatttgttataatttgataattcttttatatccttcaaaaggcttcatacttgccaaaatgagtccctttgctattttcttcctcttgttaattaactcatcattagcagcaaatacaaatatttacaatgtccaaaattatggagcaaaatccgatggaaaaactgattcatcaaaagcctttttgaatgcatgggcagcagcctgtgcttctaataaaccttccactattaatgtgccaattggaaaatacttaattcacaatgcaaacttcaatggacaaacatgcaagagcaaagctattaccatgcacattgatgggactctcttagctccatctgattataatgtgattggcaatgaagaaaattggataaaatttgaaaaagtcaatggcctttccatctatggtggtacctttgatggtcaagctgctgctctttgggcttgcaagaactccaacaacaagaattgccctgatggaactacggttcgttatgttttccataaaaaaatgttttccagcgtttagtatgatgaatattccgaaaacatgtatacttccgttttagttttatgtcaaacaagcacagctatgtctttttttaattttaccttaaatattggtgcaggcattaactttttacaactcaaacaacattataatgagcggagtaaaagtacaaaatagtcaaaagtttcaaatattggtagacggatgtcataacgtaaagcttcaaggagtaaaggtatccgctccaggaaatagtcccaacacagatggaattcatgtaaaatcatcatctggagttagtattatgaaatcacaaattggtactggagatgattgtatctctattggccctggaacttcaaacttatggattgaaggcattgcttgtggccctggccatggaataaggtttgaaacataaaacttatatttattataagcaaaattaatttatttcatttttataattgatttatcatttcaactaaaatgtatgtccaaaacttgatgttgttgcagcattggaagcttaggctggaaacaacaagagttaggagtccaaaatgtgacagttaagactgtgactttcagtggaacaacaaatggtgtgagagttaaaacttgggcaaggcctagcaatggctttgttagaaatgttctgtttcaacatattgttatggttaatgttaaaaacccaatcatcatagatcaaaattattgccctaatcatcaaagttgtcctcataaggtattgattaaacatattactttttttattattagaataatgatataacattagatcatgttgataccttaccttaatctaattaattatattgttcattttttttagggctcgggtataaagataagtgatgtgacatatcaagatatacatggaacatcggctacagaagttgcagtgaaacttgattgtagcaaaagtaatccatgtagcggcataacacttgaagatgtgaatcttagttatcaaaatcagcagactgaagcttcatgtgttaatgccagaggaagagtttctggtttacaaaaacctaccaattgcctattaaaaagttagataaattaaatttgtgtatactatcacaagaatggaattattgaagttgtgattatattataaagaatatttgattgtaatgttaaaaatgcaatatgtacctcatgtttcaattaatgttaaatgaatatcaaattcatatatttatgaaaaagcttacttaattttccagatcagagttaagaaaatggacaaattgatgaaagacgatgagtagaagagtatgatttttgagtttgaaatgtttgagtgttgttcttcttcaaaattattcagtgaagctaaatcctgagtttgagctcatttgaagttggattgatataatttcgtttgggaacaaggttggaactcgcttaagattgagctcgaaaacttgaatttacgataagaaataaaagattttgctatataacaatgatataattgttgttacattacattatatttagttgtaataatataattgccgctatattatatttaattataattatataatatgataatttataaatggaaaccaacactcaataatacaaatgtctctaattaaggttttagcttatcttgatataatgaaattacttccaccctcaattcctttttacttgtcaaatttttgattttttaaaaaacaatatgttttaccgatatgctcaactgtatatccttctgtccctaattatttgaaatttgaatttttaaaataatatctagagctcattcaatagtgtcctcccttcccccaccctatctcttctcagttgtcattaaattttctatcaaaagaatacgatccttcaactgtatatccttctgtccctaattatttgaatacattccacgacatattcaattattaagcaaataatatctagaatattagaggtacgataactaatatgttgaattagaacttaggccttacacccaaaagttagctcgaagagaggaggattgtccatgccttataaggagtctctcatctcattaaccaccgatgtgggacttttgtcattcttgtccaagccttataaggatccacccatctcattaactaccgatgtgagacttttgtcattctttaacatcccacctcacgctcagtgcttatcatctggtgcaccctgctttgaaggattgttcaagctttattaggagttcacccatcttattaactattgatgtatttttcatccttttaa

SEQ ID NO: 370 - DNA, 3617 bp, Solanum lycopersicum
  modified_base (1)..(166): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttgagggggtacttggatattatcccttttttataatgggggccctaaaaaatataggccccaagcgatgactttgatggcataggagttgagacggccgtgaatttaaataggtagaaattacaaaatataagttataataattgacaattcaaaatatataaatggtggatgaaaatatttcagtcaactattaaaaaaaaacctattcaactctcagaatttgaaaaatgtcacgtaaattaagaacgaagagtatttaattagtaagtccaatgttgtgaatttgttgtgagacttgactatttcaacgtcacgtaggaagttaggacaatcgccatcttcagataaatgtgtaccaaagtccacttttgtttgggttctgagttttgaataagcatgttataattacttctaatttgtaaatacttcaacatgtgtctaattcaatgcatgctatattattaacatcgtgtgatatttcttatactcaaatatggtaattcattattcaaaattaatttgtgtaatgttatatatttaggcaaatattggacatgagtctgttgcacaagttttaattttggagtaaatggtaagatttaagtatgcaaaacgttgtttttcaatgtttttaacacaacaatgagtgtcaacaattgcctacaccatgtgattgatgcatatgttatcgcaagtctcatttttccatatatccaacatgaccaaatatgaatgaaattaacctaactttcattgaaatctaaattaattagcaacaactttaattcactcaccctataaatatccctcttaactacttcaattcctcattacctcaatttataatttgataattctttcatatccttcataaagctttatacttgccaaaatgagtcccttagcaattttcttcctctttttaatcaactcatcattagcagcaaataccaatatttacgatgtccaaaattatggagcaaaatccgatggaaaaactgattcatcaaaagcctttttgaatgcatgggcagcagcctgtgcttctaataccccttccactattaatgtaccagctggaaaatacttaattcacaatgcaaacttcaatggacaaacatgcaagagcaaagctattaccatgcacattgatgggactctcttagctccatctgattataatgtgattggcaatgaagaaaattggataaaatttgaaaaagtcaatgccctttccatctatagtggtacctttgatggtcaaggtgcttctctttgggcttgcaagaaccccaacaacaagaattgccctgatggaactacggttcgttatgttttccataaaaaaatgttttctagtgtttagcatgatgaataagaattatattccaaaaacatacatacagtgtgccaaagaaagaattgaatattatgtcatacaagtacaatcatttatttttaattttatcttaaattttgacgcaggcattgactttttacaactcaaacaacattataatgagtggagtaacagtacaaaatagccaaaagtttcaaattttggtagacggatgtcgtaacgtaaagcttcaaggagtaaaggtatcagctccaggaaatagtcccaacacagatggaattcatgtaaaattatcatctggagttagcattataaactcacatattggtactggagacgattgcatctctattggccctggaacttcaaacttatggattgaaggcattgcttgtggccctggccatggaataaggtttggaacataaaatttattttcatttccattgatttatcatttcaactaaaatgtatgtcgataacataatgttgttgcagcattggaagcttaggctggaaacaacaagagttgggagtccaaaatgtgacagttaagactgtgacttttagtggaacaacaaatggtgtgagagtgaaaacatgggcaaggccaagcaatggctttgttagaaatattctgtttcaacatattgttatggttaatgttaaaaacccaatcatcatagatcaaaattattgtcctaatcatgaaagttgtcctcatcaggtattgattacaagttgatttgtttatcacaataatgataagattagatcatgttaatcccttaccttaaactaattatattgttctttttcttttgtagggttctggtataaagataagcgatataacatatcaagacatacatggaacatcagctacaaagatcgcagtaaaacttgattgtagcaaaactaatccgtgcagcggcataacacttgaaggtgtgaatcttagttatcaaaatcagcagactgaagcttcatgtgttaatgcaagaggaagagtttctggtttacaaaaaactaccaattgcctattggaaaattagataaactaaatttgtttgtaattcaaaaaaatgaaattgaagttgtgattacattataaagaatattcgattgtattgttgaaaattcaatctgtccatcatgtatcaattatattaaatgaattaattgatatcatattcctcttttaattataaaatcgaccaaattaatttggccataaactctatttttcatatcgatcagctgttgcctagggaggtgttaaagaatgacaaaagtctcacattgttggttaataagatggatggactccttataagcttgagtaatccttttttagggtgtgagttaggctaacgacataatatcaccgggagaaataactcctttgagcacaacgttatgtttcaacttcttcttaaaagattaataattgctaggagcaaattcaatttcttttaatataaatttatattttgttacaataagacggttgttgagaaaataaatatggcatggttgcttcctatatagtatctcataaaggcatcaacgtgtgttcaccgcataactaacttacgagagagaagaaaattactagttttgaaatgagtaatgtaaacggattttttttctttgcagttgttgttgaccaaaaaaaaacttttttttttaccatttcgagaagtatatataaaaagaaatatgggatgagatagaagtgatttgaaaacttttgagtttgaaatgtttgattctttatcaattcaaaattatttagtaagctaaatctagagtttgagctcatttaaagttgaattgataccaagtttggcaattgagccaatccatccggtttcagcccattaaagctggggcccgggctcgcgtctgataaggttcggatcggaagccagcctgggccgattcagattcacccacaggccggtaaggccatgtgaaatggtaggtggcctaatggtgtaccgacccggtaattaataaaaggacaatttttaaatataacgaatataaaattcatatttgtatgctatatagtaaagtttgt

SEQ ID NO: 371 - DNA, 3467 bp, Solanum lycopersicum
aaaaacatgacaattaaaatgaaacgaggaagagaagtacatatttacacgtagaagttatgtgaatttaaccatgtgtggttttgcgtaattaaagctatcaaatacctagtggctagactatatatactttaccatagactaaaaacaattcatgaacattaattaatgaaacaaaaaaaaattcaacttaggataaatccatttgaatttgtaacagtaatatccacctaatttttgacctagtcttgtattaatctaaatagtcgtttacctaactgaatatacatataaatgtgtataatttatgtatatcaattagtactatatctttgtgttgggatctctttaattaatttgttcctaacattccattgtaattaattcaacacatgtgatattagagcctcactttgttatatacttttaaatagtatgcactaggaaacattcaattacatgaatataatcaaattattctttcatacttcgcgattattgacttaatgttattatattttaaatcgttaaaattgttaatgctattgatatataatactagttataaatatttatattttatattatagatgcaaaatcaaatctgttggacgaacaaggatggaaataggagggttgcaaagaggcatgggctatatttttctatatttttaatgtttgtatgtaacaaaacacaactacattgctaacatttaaagttatttaattaatattcaaatgtataataaactttttatccccttagttttctccttaaaataaggtgccaacaattttcttgatttttggccatgtgattgcatatgatttaaagtcttattttcccaaatcccaacatgaccaaattgaaaaaaataacctaactttcattctagttcaaaaagcaactattaaaaaaatatttatttttatttaccaatgagagagtatacccccaaaactctataaatatcactcaaaactactactccaattcctcatcaattaatattccaacttcccctttagcaaaatgagtcccttagcaattttcttcttctttttcttcaacttatcattagcaacaaacaccatttacaatgttcaaaattttggagcacaatccaatggcaaaatagattcaacaaaagcatttttaagtgcatggggttctgcatgtgcttctacgagcgcctccactatttatgtgccacgtggaaattacttgattcgtaacatatatttcaatggtcaaacatgcaaaagtaacgctattgctatacatatcgatggaactctcttagctccttctgattataatgcaattgacaatgatggaagttggataaaatttgaaaaagtcaatagagtttctatctatggtggaatttttgatggtcaaggtgctagtctttgggcttgcaaaaactctaaaaagaattgccctaaaggaactacggtacgttatgttttttccatttttttaaaaaaaatacttggttgaaccgatgtttttatatcttacgttaaattttggtttcaggcactagctttttacaactcaaacaacattgtaatgagcggagtaactgtacaaaatagccaaatgttccatattttagtagatggttgtcataacgcgatgatacaaggagtgaaggtgttatctccaggaaatagccctaatactgatggaattcatgtacaatcatcctcaggagttagtattatgaactcgaatattggtactggagatgattgtatatctattggccctggaaactcgaatttatggattgaaggcattgcttgtggcccaggccatggaattaggtttgaaacacaacatatcaatgattgattatatattcctatcttttttagtgaatttactttgatttttatcgttcttacgtgtagcattggaagcttaggttgggaatcccaagagcaaggagtacaaaatgtgacagttaagatggttagcttcacaagtactgagaatggtgtgagagtaaaaacatgggcaagacctagcaatggttttgttagaaatgttttatttcaacatattgttatgagtaatgttcaaaatccaataatcatagatcaaaattattgtcctaatcatgaaagttgtcctaatcaggtattaattatcacaattatgatataatagtatcaatcgcgtttttccataccttataatctactcaattttttttccagggctcaggtgtaaagataagtgatgtaacgtatgaagacatacatggaacatcagctacagaaatcgcggtgaaattagattgtagcaaaacaaatccatgtagtggaataacacttgaagatgtgaatcttagttataaaaatggtagagctgaagcttcatgtgttaatgctggaggaagagcttctggttttgaagaacttagtaaatgcttataaattatacaacaaaaaaaaataacaaaattttatatatttatacatgaaaatatagttggtaattttaatatacataatgaagatggataatctaatctaattataatgatgtattttgtattcttttgtaataatatactattatttatatcctagttgttataatttctagctactttacaaaaagaaaaagaaaaaagacattgagatattttattttatttactttcacaaaagttaaaaaaaagtcaaaaagcttatatccactggccaatacctccatcattcataaaatatcatagtgaaataataaatatttttttattaaagacacttcatttattgttatgtgaaattttttatcgcaaatttagatttaagcgaaatttaatatgagtattagaaactagatggataataaaataaaaagggataatgtttaagtgcccctcaatctatgtccgaaatctcagagacacacttatactatactagagttctattactcccttaacttattttattaataattttttacccctttttagcttacttggcactatcttgtgggccacgatggttgattttttttcggaactagtgccacgtaagctaaaaagggatagaaaattacatataaaataagttcaggggggtaataggaccttagtatagtataagtgtgtctctgggatttcgggcatagattgagggggtacttgggtattttcccaaataaaaaagaggaattttcacaaatagccaccgcaataaatgtaattatgctccataactatagttaacatatttactagttgtagtacagtttaagcttactcgtttgtataatttgtataattcgtaggtatatttgtataactcagttatttttgtataaacttcaaaaataaagaatttatacaattacaaacatcagaagtataaatattcgtacaaattttaaattatacaaaaattatacaaaatatattatataaattttaaattatacaaataaa

SEQ ID NO: 372 - DNA, 6936 bp, Solanum lycopersicum
  modified_base (6863)..(6936): a, c, t, g, unknown or other
aatttaagttatatacattttataactctatttttaaataatataaatattttattataaaattattataataaaattgaaaataaagatataagcacaatattataaatcataaaagaaattagtatcacaaaaggaattatcaagggagatctctttgaaatattatttgattgaacatgaattttgaaaaaaggaagtaatattttttgagatgttgatctaaaataaattttaaatagttttgtgaattaaataatcttattaaaaataaaatattttttaaattttaaatcacttttagatataaaaataattccttttattatcttttaatagtccttactgatttagcactctcctttaagaaataatttaaatatatgtagcttttgtaatagaataattggttatattttgatcagaattgatattcttaaataaataaaattaagaaaattacgtaactatcacatataaaaagtgtgagtttttataaagacttttaagatgataaatttaaaataaaattgagtttaatcttcttcgatccacctaatttgacaaaaaatttacgataatttatgagataacataaaagtacatattcttaaaagatagataaatacataaaacaatatttctatatacgcaccaaaacatttaaaatgagagtgtccttttattagaataaagttattttactaaattagtcataataactatattttagaaataaactagtggtattatatgtatagttatttaatgttttttctaaaaacgaaaaataatttatatttgatattaatattagattttgattactttgaatacgctttttataatttttgtatgatagaaaagaaagataatcttattaaaaaaaatttaaaataatttttattgtgggtgggtagggtggggggtgggggtggggggctaaggtgggggtggggtagaaatagtacaaaagagagagaagagagaagggggttttaccaaacccagaggtttttcaatcctgtccacaatttcacttacccaacaagaaaaagtaaataaaaagtgttgtaacaaacaagtacaaattcttcttcttcttcttcatttttagcattttttttatggcttgaaaattcataattctcatacaaaattcatagatttctactcaggtaattttttctattttttttggtattttatgctctgttttttggatttttttttgaaattttgttggatgcagttttttgtgttgttttcaacaagggtttgatgggtttttatggtgatggagattggttgagttttccggtgaaaattcaggttgatcacagggagatctgatcggatttgatgaattttgtttggttttcagttagattgtctggaatttgatgttgttaagtgaaaatttgttgaaatgattgaatttgggtgagaattggaactgggtttgattttttagttattatcggtgaatcgaaaatgaagtagaatagatattagttttgattgaggtgtagttttgttggttggatcaaaagttaaaattttgtgtttttattctgaattgttgctgattgaaatttgggtttgtagagatggatctcttatacagaatgggatgtttttctttagtgttctggtgaaagttttggtttttttttgttgttatgctgataccttctttcgagaacagtgattgatcttattcgagttgtatagtaagcatttttgtatatatatatatactcgtggctagtagaaggatctcggattctgcatatattgatgttggttcagatgtatggtttccttgtatttgtggatcagctaagtgcatttggaaaatacaacaatgtatatggtgtaatcccacaagtggggttcgaggaggtgtagggtgtaggcagaccttactccttcctttgtagggggtagagagattgtgtagacactcggcttatgtgaaaaattatgtttgctttatgtaatgatattacatttttttatgtgcctttgtatttgtagtcacttaaagttttcaacttttgaacattgcgatgatgtatatgttgtctttggtcaatgcttattgtatgatgattgatgaaaactttttttttggtgtagattggtgaaatcagtgacattggtttattgcatcgggtgatcacttgttggcatgcttctgaagatatggtgtataagaagaagttagattttggtttcaatggctttcaagttccagttatacctaaagctcctagatcagttagagtaaggatgctgaaattgttaattgtctgatcttttacaagtcttgtatttatatacttttctaaatatcgtctgcgattctgaatcatttcagaggagacgttcctgtaaaaaattggatgatgatcaaatttgtgcatttgaattattggcggctgttgccgggaagcttttactggagagcgaaagctctacttccagtaatgcagcagaagggaaaaatgaaattgctgatggcagggatggtattaaaagcgaacaagtggaagaaggtaaagctgtgaaatcagagtgccttgaccaggggagttgtgtagaaagcgactatttacccgacactgcagtccaagatcagaatttgaaacatggtttcgataaacctcatcatgcagaaaataattatttcttggagcatacttctactgttataggttctgacgctgacttgaagttggaaaactgcaaggaggtcaatataactgatggaaaattccaccacaaaattgaaggtggatcctctagtctcgaggatccatgtgatagtaaaatcaggacaggaacccaaaagcacttagatgatgacagcaaacagattgaagacgtaactgtgactaacacttgtagtgtaaagaatccaatcaaagaatgtgttaataacagtggcttgtttaactcagatggtagtgtacagttacccttgtacagggattcggttcctagtgcttcttttgtaaagcaaaggaacagtgtaaagttaggtgttagagatgatgacgaaaattcttttgactgctatagatatagcaccaagttaagggcctttaggacgacatcacgacttggatacagaagaataaggaagatgctgaaatcacgacactggaaagtggctcccaagttgaaggaatatgagcgatcttacacaagtaagtgtagaatatacctgacacctccgaaattttggcagcttaagcttttcttgtacatgtttctattgtcacttcatgtcattttctaactacatggatttggtggtttagatggtggaatggagtccttttacctcagtaggaaaagtgtacgtgcacgcaagagatgccaacttgaagttccttccaagagacggaaattgagcaaccatggctttgctgttgcatattaccaggaggccagtagcgaaagcgttacaaattcacctgacaaggaaatcaaacgagacattagtacctcgcatgccatcccgccgagaggtcaatactttactattgaccttgaaattgaaggtcctggtgatttatgtagtcatactaagtaatattctgtattgctttacaggaactgctgatccagcttcagttaacaatcatcacaagaaggaccctaatggtaagggatttttgatttcatctgtttgttaaattttccctcgttgataccttgcatatttatcttctatagaacttctaacttgagtccaatatatcctttcagttaaatttagcatcaagtctttcaaggtgccagagctttacatagaggttcctgaaactgcaacagttggctctctgaaggtattcagggtgtcctcttttactcctcctctgttgaattcaatagtcccccacctccctaggttgactaagaaacttcagttgacgatttctgctttgctgaatgttgaaaattattgttcttgctgcatctgtcagtcaatatagttattcatttaatctttctcgtcatttagtatgtctctgaagccgcttaattaagaattctctgatatgcagaaagcttgcattaaatgaaggaatgataatgttggcagttgtaactaattgatttgtgatgatgttagaaagttttgtttttttttagaattggaagttctcgaagctaagtgctaattttcttatgcagagaacggttatggaggcagttacagctatattggaaagtggattacgggttggggtggttctccagggaaagaaggtcagagatgacaatagaactctggagcaggctggcatttcccagaatggcaacctcgataatttgggtttcactttggagcctagattcacccaagtttctccatcatcatctcctaataaacttccggcttcatcaacatatgttgcagatcaggaactaacaaggtatgatcgaagagttcagcactcctatgatttcaactagtgtgttgctttggaaagaaatgctagttgcaaaaccaccatttatgaaattgactgggtttagactaattagttatatttatgctcaggcggcgacctagtcctataatggaatttgggattcacaatgcttcagcagaccctctagagactgatatgtgcaagtacagcgagaataaccatccatcagagctatcgcctacaaatcctattgattcatcaaccgatgtatctattccagattctagagccttggtgatagtcccttcagttaatgcagaggcacttgctatggttccgctgaaccataaaagtaaacgttctgaactttcacaacgtagaatacggagaccattctcagttgcagaagtagaagcactagttgaagctgtggagcatcttggaactggaaggtacgagaacttcaaaatcctctttgctagcaaaacaaattgtccgctagagaactgcatttctgataatttctgataatcaggtggcgtgatgttaaaatgcgtgctttcgataatgctgatcatcgaacttatgttgacttgaaggttagacatcttattggtgctattattgtttctgaggattctaatgagcaagaacgtgtgttccttttccatgcattatgccagttcttgagaaattaattttttagaatccttgatgttatcacatattgttcttagcaaataatgctcatggtctcattatcatttggagttcgcatcccacgtcttagatacacctctgcttcaatttttatggcactgttttctttttagtccgtttaaaaagaatgttacgaaacgagacattttgaaaatcagtaacttccccaaaatttccgttcttacccttacaagatatgctgttagagccatgtgtatgtcatgacatgtgttagaccgtaaaattccgctatgtaaaatgaaatggaaggagtattagtaactcaagaaaaggtctctcgtcatgtgacaagatgctttacatattttgacaatccatagatttattatattgtaaattgttgttataatggcttaatgaatctaatgacagctatgaatgattgcctagaaagcaaaagtgggaacatatgagttgttctagataagagcatagatctcactaattttttagtctttgtttagcaaatggtaatcattgttcccatcatccatgtgatgtgtggtgctttgtttatgtaggataaatggaagacattagtacatacagcaagcattgccccgcaacaacgaagaggcgagcccgttccccaggaacttctggacagagtcttagctgctcatgcttactggtctcaacaacaggggaaacatcacgctgaacttctaaaaactccagatgcaaaagcacagaaagttagcgcttgaaggaattcgtcgaattgtcaatgatgtaaagaaactattatattagggtaacacgaagagcacgacgaggaaactgtataaaaggattcgttctgtttctcgtcaactcggttagactcactgatttgttgccttacaacagttgtgactttgtaaattgcttcaggaataaagctgtggtaaccagcacatgtctcttagggtttactttgtttctgtttggttctttcatttggtgttattagggttatggaaagaatcaaatgtgtattaaatatgtacattactagtacttccaattgattttctagtgtaatttcactattgtatgcaactcttatgatatttagttgaatctcatttcaagtgttttgttattaagtatgcacatatataagataatattgcgtacaatagagtcgatgtgattccattctctctcttatactttgagccccgaaaagttaaagtgcatcagaccgtcttttagatgaaactgaggtgaatgacttcactaaaaatggcatttttgtactaaaccgtaggttcatttctccatttcgatttgttgctagtcagaattttcattaaaaagtttaaaacgcgaataaattaagaagatgcataattttaaccttttatattgtgtaaatatttacatgaataaataaataaaaataaaaggataatgaaaaggatagggaattcaatatccacacatgattttgaggaatataatataatagttgtcggtgattatattatatatacgtatatattcattttcccctcttttaatttaatttaatatatccaatgggaaagccaaacaacacgttacgccatgtgagatttatgacttattctaaagataggcaactcttttttatttttttttgccttttttcgggggtgggggtgggggggggtggggtttggagtcgcgtcattagttagatagttnnnnnnnnnnnnnnnnnnnnnnnnnnnnnnnnnnnnnnnnnnnnnnnnnnnnnnnnnnnnnnnnnnnnnnnnnn

SEQ ID NO: 373 - DNA, 3998 bp, Solanum lycopersicum
actttggctaatgtttgttatgaagtacaattaaatcaaaccgtagctatttcatttattttatgttattaatttgctattatatacgattatcaatatcataataactagctttaagtaagatgaacttaatatttgatggtgaattaataattagagttagtagcaaattttggataggcgatcctcttaaaagaacaaaaataaataacaaaagaggaaatatgttttgatgaaggaatcaaattgtccatttaaaactattcttaaacgtaaaaaaaaataaaaaaatgaataaatatggttttcaagagttatagatttttccaacattgccaaaatttgattatatactagcatcaaagatttaacaagtgggtcaatatttatcttttgacaacgttttcctattcttttctcagactatgttcagcacttgaattgaaattcgattaatttaaatttacatcgtgtaagattcattcagaaaaataatttcctagataagaatttttgagttcatcacgtgtaaaattcaatttggcagatatattctttttatttttttcatatttaaaatttaaaataacttcttataaaactatataaatttattgattattactcgcttcattctaattcacgtgactcgcttttaactttaatcttctcaaacaaatgtcacttctatgctattagagatataatttttttttttaaaaaaatatattttattttcttatttaataatttataattacacaacatttaaaatttattttttaccctagcgtggacgaggatattttgattctattaggattagtaaagtaagtaatatggcctttgcactagttgagacatggggcagagtgcggcggcattcagaaccctactcaaattggggtaggcaaatacgtaattctggattcaaggcaggttattttggtaatttacaagtgctcagtgctataaagacaccgtactccagccaaaacccttcttctcgagccttcactggtgcgtcgttttcttcctctctcttccaatcaaccctaactttagagagagaaagaaaaaggctactcttccaccatgttggtttatcaggatctcctcaccggtaatctcttttatccttctgcggttttctatttttttctgttaagttttgttttttttctattttttctaatattttgtattaaattttttggtagaaagttgtaatattgaagttagagtagttttgctgtagcaatctgtgtagtgaatcttgtttggatgattggcggttgttgatgagtctccttgtgttttacgacaacgggaattttgcacagattgttgtttatttgatgcttgatctgaatctgtcaataagatctgcttgatttgcgactgattttactgtgtaaaggcagtactgcctcttttttcttttttgttgtgattaaggaactagatctactaatctggatcttatagatgtgattcctatgttctttcccttgatttatagatctaatgctgtgtatataagatactgtaggtaagagccatatatgagtaatttggatccgtaaactcgtgatatttgttgcttctagttcatctagacttgtgcttcatgttacacaggaaatcctagttctatgtatccctatagttctggttcaattaaacatcttgaagtctatagctcattatttaaactggttggcaatccattcaagtatgtattgttatgtgctccttcgagttgctgtagctgcttgatctgtcaaaattcactgtttatagtttgtttgtagcagtagctttgtgcataccagctttaaatttttttttaaagtcccattcttggtatggtgctgttctttaaacctacaactcttcaaaaaattattgcaggtgatgagcttctctctgactcatttccctacaaagaagtcgagaatggcgtgctttgggaagttcaagggaaggtaggtctccatttaattattgctagcaaaatttccatatattagcaatcaaattcttctggactatctagtctaatttaaaaagagataatgtaatgtgttggttaccttacagtgggttgttcaaggtgccgtcgatgtaaacattggggcaaatccttctgctgagggtggatgtgaagatgaaggtgtggatgaccaagctgtcagggttgtcgatattgttgacacttttagacttcaggtttgtatacatagttaatgacgtttcagtgcattttaatgtacttcgaattatatgtgaataaatagtggtttgctattgcaggagcaacctgcttttgacaagaaacaatttgttaccttcatgaagagatacatcaagaacctgacacccaagctagaaggagaaacacaagaagcatttaaaaagaacattgaagcagcaactaagtttcttttgcaaaagatcaaggacttgcaattgtatgtccattttaaattgttttatgacattgtctaagctatttcttactgaagttgaatgtgttttgttttccttctacttcatacctggcacctttaatagaaactgatactatttgtgtgtgtgctggcagctttgttggtgagagcatgcatgatgatggcgccctggtgtttgcgtactacaaggagggttcagctgatcctacctttttgtacattgcacctggtttgaaggagatcaagtgctagatgtctggtggagtgcttctgctagaagttttgcattcgagattatgtttcatgtagtttttaatatttggtcttttttgcttatttatgtctggtgtttcttctaaaccttgggtacttgctgtaaccagtacggcagtacctgcagtttttctttatcatatgatcttattatgtgggacagcaaatggttagctgattgaattggaagtgttctgattaacaattttgcctatttgatcttttaaaacaaatttgatatgttgcctgaacttgctgtttagtacttaatttaacttctttactttccatttcatttgttgtttgcccatacctaaaatgaaggtcgatgcttcgtaattgtatgaattgaggatcaaggtatttaagattaaaatttattttgctgctaggccaaacattcctgagagcctcactttttaactgtcacgtgtccacttatcatttgattcatgtgtagtatgagcaaattttaggtataacaaagattcacatcatataaatatgatatagctatagtttgtaaattttgtgtttgctacaaaattgttaatctctatattttgggactccttcccttttatatgtaatctgattttttaaaaaataaaaagaaagtaatttcttcttttctaagataaaaagaagaaattcgttaaactgtgcacataataggattcttttccttctatgtcttcttcattagtaatatataagtatttttcttttatacaacaaaaaaaaagaatatatacttaaaccaatttttataccatgtatgtgttctttgttgcttgtcaatttttttaaatgctttggccccaatcgattaagaaaaactggtttggggagattttaggggaatcgaaagaaaatgggagagaaaaagatggggaatagatttgtaaaagaatatttcatcttctataaaaatgggtgggttccaactaaatgacaaaaattgtgttacatatgctacttgatttatatatttgctattatgtataatatttctcaataatctatcatgtgcctacttgttatgaacaatcttaagacatgtataacgagcaaagaacgataaagacgagttgtggtgaacttttgaggaaatcagttggtcacttaattattaactctttttttttgagaaagtctttaattttgatttttaatttgaaagtcgtttgactatacttttttctctcaaaaagtcacttaacttgaactcaaaatctgctcaaaaatgtt

SEQ ID NO: 374 - DNA, 10078 bp, Solanum lycopersicum
atacaaaattttataaactgttatagaaatttaagttttaaatatacaatcacacaattaaacgtaatggaatcataaattaaactataccaattatataaaaacatcagtcttaagttatatataccatgaagcagagtttttgtcaagactaggtaccacgctaacatcgtcctcccaaattactatactatctacccctccgagcatactatggcgcttgtaaaagatgaccaacagagagttatatctactaggctcgttttaagaataatttgtattaaattagcatgttttgataaggtagccgtaataactaatatataaaaaatacgtggaagccaataggcttcgaaactatgtagaggccaatatgtctcaaagccatgtaattccctaactataatatatataatctatcataaaaaaaaatcgtgctatataaggcctcattagtgaagcatttccttttaatattttttattataccaacttcatttactatatcatattttttaacagtatctctatcttattataacaaataatctactccctcagttttatattagtttatcatcatactaaaagtaatatgtgtggaattagcaatatcatcttcttacttataattttttttcaataaacatataaaaaaaatcaattgatataaaacgaaaaaaatattttatttaaaagaagcagtgattatgaatgtataataatatttatcaaatattaattcgtgacgaagctactattttcaccgaaatttcaaaaagatggtgggcgttattccattgtttcgcatcacctggctacaagatgcgcacggctattgtctactgtacaaaaaaaaacttgtgggttttattgagacacataacaaataatccatcttctctgtccaatgaaaaatcgacaacacatttgacgaaaccactctggttttttaaaaaccactatattctctctcttccacatctgggatattttgcccaacaaaagttatttcagataccaaacagagaaacactactccacacccttctttttttttcttccgtctgtctccatttgatatgatatatatattacaacaacaattattcatagtatagaaaaaatatccgaaaaaatgggaagaggaagagtccagttgaagcgaatagagaacaaaattaaccgtcaagttaccttctcgaaacgtcgatctggtttgctgaagaaagcccatgagatctctgtgctttgtgatgctgaggttggtttgattgttttttctactaaaggaaaactctttgaatatgccaacgattcctggtacgtactctttcgtctttaattctattgagccgccctgattctctttttccgctcatatatctctttttaaatttaattaaatatgctcttatactcttgatcttcaattagagattggaattttttttttctattcattttgactttttgatatctttttgttggtgatattttatgtgttaaatatatatactgtttttttttgttcttatgtgggtatttatatgtaaaaaaataatattattagtttactaaactgcatgcagaaaccaattaaataaataatattttacaacataattataatctcgatagatcctgttgtttttgtttctttatatagtctaaataatctcttaataaacagatccatgattatttcgtgtttagtaggtagagaatcacgtggttgttaaagtatataaaaaaattatatatgctcttttttctttttagttttaattttaatttaatttatttttattctttttttaatatatataatatgtaaatatgtaggatctagcttatgacgtgatcattctgttaaaaggatgttatatttttttgaaaaaaaagttattaaaaactatatgtacagtttttcttttaataattctatgtataagcacaatagtaaaagtatatttcagatgatgtgtgtgttccatgcaagtgcaaactgactaccaactcttcaaaatttttgcagaaacgaggtctacagtagaacagctttaaagagcacaaaaataactattcaactagcatttaaagcggatataatcctcataaaaaaaaagtaaaataattatatgtatatatacactatttaccaagtacactttttttaattaacagaattatatttattgaattgaaaaaaacaaacaaactaaaattgatattttaatttcaaaataaccacataattgaggaaaataaaagaaaattcaatctctcggtcataaaatgagttttggattgaacttgaataagaaaaggaatatgtataaaaaattttaaagtcatctgatatttttgaattcaaaaagttaactttagatttttttaaaaaaatttggttaacgaaaagggtaaatatgcaccataaatatttatcaaaaccaaggtatatatcatttgttaaacgtctagtgtatatatgtaccattttttaataatggatatattttctttaaatcacaaagttgaaaggtatatatttgccccttttccctaaatttattgaagtatattgctcgatttgtttacttttttcagtttattaaactaaatataaatatctatttttacttgttcagttttgaaaacaagaaattatattacattaagctgcattaaaagagacaacgcatgtattcattttgtatataactaatactttgtttgatatatttttttcaatctatatataattaatgacagtctatatattaggtattaaacaatctaaatcattatattaacaatgtaaggggttttaaaacatgtattagaatgattaaagtcataattgcccgtcaaaaccttttccaaatctttttcttgatattggtggagagtatttagtaaaccaattctttttaaaaaataattatgcaacgtacgttattattaatataccaattcaaatactgcataataaataatatcatcataactaaaatcaacattacttatacatcactgttaacactattcttattcaccttattaaacaataactgaagtcattttcaatgcattaaatttattatatttatagcttattactattttttaaaaatatttataatatatatgtatatattttaaaaatatttcttaatatatattctgatggtaggtgcaatagccagacatgcgggattaattataatctatagttttgagccaaacgttagctggatatattcaacgaatttattacttgtacttttttaaaagctatgtacattaatttttagaatggtatattagagtagccagaagttaagatttcgattttattaagttacctttatttattataaaaatgaattttcaagtgcttattctaacttattaggtaatttagagcgaattgcttgatgtactatctgaaatgatttttcacacgttaacttgaaaagtaaaaaatttcattgcttagttgtgtaattatgtaaattcaaaatgggttgtgagttaattaagttgggtcatacatggatgggctgggttggtattttatgtggagcaataaataaaatttaggacaaactcaaaataggtgacctaatggtcgccgcccgactaaacataccaatagtcaccagattcatatgagctactgaggagtcaactttcacatattgcaaataaaaaattcatatttgtatattatagcaaaatttgcataattgcgcttcatagcaaacatagaaactgtatcattcgctatacatatatagttgaagcaaattgtataaaacgaagtgtataaaacaaaaaagagaaagacacttagacagagaactgtataaaaacgaagtgtataaaccaaatagtattattataagtgtatagaacgattatatacaatttgtatttgtataaaatgagaaagagagaaagacaaaagagatttgacacggaatatacaattgaatcaaattgtataaaacgataaagagagaaattagatacaatttgaaaattgtataaaacgagaaagagagaggcaaaagaaactggacagaggagtatttttattgtataattataagtgtataggacaaaaatatatgtacttgcatgtgtatatacaattttctcacgctttatacaaacagaaatgcaatttatatattttgcttctgtttgtataagtgagaaaagcaagggtggcgagcgagatttgggagagtggcgagcgaggggaacaaaaatatgtatttatacaatttcctctgctttatacaattagaaataatttttatacacttgtgtttgtataaaagtgaggaagcgagcgagagattgtaggagagtggcaagcgggatatttgggagagaggcgcctgacaattttttgcaaacgtttgctatggagcacaattaaatcaaaccctagttactccattttatttaggttattagtttgctattgtatataattttcctaagcaattaattaaaaattatttagatgcaatataattatactactaatggaggggaaattttaatcttaaaataacacaagtgataaatttgatccagtggatagaaagaaaagaagaagacattctgaatatttttaataggttaaatgacattttaactttttcttaaggaaatcttaatatcaaagttggttgactaattaaaatttcatattgttgatgaaaattcgattcccagtccttaccctacctccgttgataaaaaaaccctttctagctccacaagcaaggtctgattgtttaattcgactcaaaaaattatttatcaaaatatagtttgaaagaaaatacaagaataagaagctatatatatgaactatgaagaaaatattaaagaaagaaaattactaacaatacatatattaaagataacctaagtaaattcaaagaaacaaaattaaataataagataatactaacattatagttgtaatattgttaaaacaaaattgaagaataagataatggtagcattattataggaatattggcaagggaacatatatgtatgctatctaggctagaactttgtctaggaagacagaaaatgtttgattacctactactcgtctattcctatctttgattaacacacccttttatctaggattatatctttggtgagttaaagcagagttggagttaggattcaaatcttgtgggttcaagaatctagctctttcaagttagtggattctaaattaataatacttaataatttgtacatattgaatagatttctcaaggcatatatagagtttggaccaaagttactaggttcgaccgaactcatgtctctagaggctagctctgctcctgagttaaagtgtcatatcttgtctaatcacctatttctatttcttcctcggtctatctctacctctcctcaaacaatcatcgccaccctataacaatttcttttcaaaatgttatatcacaaaaattttcaatatctcttctctctatgcttttgatatattatattgatatatgtctctatgcttttataagttactataacttatatatgaacatgtctatgctcatacccttacatcatgtgattttgactaattaaattgcttctacatatataagaaagggaatacttttgacaactatatttgtactcctccttagcattgtgttttaactttagcttctagttgttattcagaagaggtcaggcaggtgaggttggggttaatggtaggaataaaaagaaaaaatgaatagggaacaaaagaaagagggtagataagtaattaaggtagtttaagtctatattatgacattaatttgagtaagcatgttaattagaacaaagaccacatcttaataagctaaacatgaaatattcaaaccaaaattaacttaaagaagttcaaaagttacacatatatactttaaggtaattgttttcgaccttcgcttatagctctatccctttttcatatcaacaaaatgtgtttgggccaattcttaggactaagtgtaactgttgaaactcgataataataagcccgctcctctacacttttctacttaatttcatactagacttggttcgaacttgaaacctatgtcacgagtttcttaaactttatcatttgaactaaacaggaggaagagtaataagttgtatacgttaatattgtgtatagcttattgttcaatttctcttttacgtaaacattgctctattaataaagttatctaaggacttgaaagagaataatctctatagttttgtgcaattcctgtatatatttcatttttttgtatttgtttcatctgacatatgtatattctcttgtgatactatatatatatgtatgtaattagcatggagaggatacttgaaagatatgaaagatactcatttgctgagaaacagcttgttcctactgatcatacctccccggtatgccaaattctttcgtgttacttatatatatatcgtcagtatatagagcttaaatctcgtttttgaggaggaagttataaatttatttggtgcaggtaagctggacccttgaacatgcaaaacttaaggccagacttgaggttctgcagaggaaccaaaagtacatacatagtcacattaaagaattttttgtgacattatatataaatatgtatattttcccctttacttagaaaattttatgatatgtttgcaggcattatgtgggagaagatttggagtccttaagtatgaaggaacttcagaatctggagcaccagcttgattcagctcttaaacacattcgatcaagaaaggttcaaccaaattatatgtttatacaatatagtttttatttgataaataactctctaaattgaagtttttgatttcttttgtagaatcaattgatgcatgagtccatttctgtgcttcaaaaaaaggtgagaattttcttcaaaagtgtacttaatatgatgtggctgtctaacaacttgagtccaatttaaaaatggtttccctagtggaagtagcgcgaaacaagttcagtaattgacattctacgtatactaatcgcctcctctccaccctccttcccttgcgcccggccctaaccctaaccctctacctcccatcccgtagtttttgtttcaattatctcttacttatcaaacatgaaaaaataagtaataaaactactttttaccaaagaaaacattttcgaaaaaatatcttacatgttatcctttgtatcaaacacacctatagtttccaacaagtcttgcaatcaacaatttgtttatatctcaatactgttaagtcttcgacttgaccattacaaaagctactagcttttgaggttgtgttagactcaggttcatatcattatattgcataattgtgtataccaccaaattgagtaactttttgatgtttgcatttgtacaggacagagcattgcaggagcaaaacaaccagctttcgaagaaggttattacaatatccccaaataaaatacatctacttgtcacaaatacttatgtgaatattaaaacaggtgaaggagagggagaaagaggtggcacagcaaaatcagtgggaaatcaactcatcttcatttgttttgccacaacaactggactctcctcaccttgggtatactcctctttcccccttattttattcttaacttttttattttttatttaatgacatttgatataaaaacaagattatgaaatgagaaaaaccaaatgacaatcatctaatcaacagttcttttaaagggataattgccttgatcaaatgtctatatactatagatttgtataaatcatatgtggtcatccagagcaaaaaaatttaaacatggacgatttttacctgataaactttaaagttatatgtcttttatgatattaaaaagaagaagagtatttttatttaataaacttttacttaaaaaagtttttagattggttaaatgttttagccaaataattaactacttaaaaaaaataaagttgcatatgcatatactactacaataacaacaatctttagcggcaataaatatagatattagtaaagaatgctaaagtctttatcgacatgtgttcaataccattagaataaatattactaaaagctttaaaaacatatatagaaaatactaattgtcgctaaaaaatatatatataacaacaactaaaaaattaattattgctataattatttttaatgtatcgataggagcaattctggcctttcactagaagtctagaagcatatagagccaaatttattacctaccaaaactttgcaccactctaccttggattatatttctttttattaaaaaaaagaaagaagagatgcattattggtggggatagctttcttggcaacatcaaagtatgtgaattgtggtctatcatatagacatatacaattaataagcactatcgtaagattagtaagtactttatttttaattaaaagtctataaagttgtactggacatcaaatagaaaagcaaataaaattagatgcaatacattaattgtagttttgaacctcaggttcaatatcgaaacattttggctattttttggttacatattatgtttcgtaacaaaattactggattgatttaattgaaaatgtaatgtagggaagcataccagagtactaatgtaatagataatggggaagtggaaggaggtagttcttcacagcagcaaggtgcagctaataatactgtgatgccacaatggatgcttcgtcatcttaataattaaaaggtatcattaatacttcaatataattaactaggtatataattttgatgccacaatatattaattaaaaggtatcattaatacttcaatataattaactaggtatataattttgatgccacaatatattgtctatgtgtacttgctttcaaagacatgccacaatatagatggattgttgtaaaaacattataatatatgttaaaaataaattttgatgtatgattccataatatcacgtaaaggattttgtagtaattatatagtaataacttttatattatatttaacgataacaataaatatgaatatttataattaacactttacataagtgttaaaggatttagtaattttgaatgtaatattattaactcatgttgtgagtatgttgtttttatgatagttaggagatatgataatatatataacttgatgaatgattgatgaataaattttttaatttattcgaaagatgcttttggttggttataggttgtcaattatttatccataaaactattgttctatagcataaaattaaatagatattacttaaaagatataaaacaaacggacaaaagacactgcattttctttgtcatcttttcttgattggtactaccaaaaaaaaaaaatcaattttcagtggttgtttggttaaaaacaaaaatcacgaatgccagcaagaattttctatgcatgtagatatagaatataaaaaaaagtatatttttctaaatatttgacttttgatagtatgatattgatgaattggtataattagggatagggaaaaattttaaatatccctaaactattcgaaaaggttcagatatatttttttaaagtttggtccatttaaaattttagccgtttaacttttggtctacatatgtccttttgggcgttagttagccaattcgaaaaatctaactcattttatttttatttaaatgccaaatggatttttcacatcatttttatatattatcacttgatatttattttcaagtatgaaggatttaatattacttttttttcatacaaaatacatcccgattaatttgataagagtcttttatataatatcgtgatctaatttatttatttttatttggattgagaataacataacttcttttaagcaacttttaaaggtgggaattttggtaaaccaatgattagaaaaggattacatagaatactagcaagaaatttttaatatataaatt

SEQ ID NO: 375 - DNA, 8335 bp, Solanum lycopersicum
ctttaactatggtgatgcacaacgtaacgaaatcattttcattaccaatattatgaatttttacattatatataaaataagatatataactaatatccatatattatattacatatataaattaaaaatatataacgaacaaaaatactacaaaattaatggaatacactctatgaatccagcatacacaaatagagcctctacgtaagccagttgttatctaatctgtttagtcactatgacatcagataagatatctgtttagggtacccgtttacacatcagcttttaaggtttcctacttaccaaacacttctccttcaccaaattgtttctccaatctcattcaaacaaacacacaactaggtggttcgaacaaactcaataatttttttttaaaaaaaatttatatttatactaaaaattaaataaatatacatgtacatttgtttcttaactcataacaaaattaattaacgactcagtgggatcgtgaaaatgttttttacggctaaagttatgaatttaaaccatagtatccacaaaaagttaagtttccattttttttcccaaagaaaatttaaaataacaaactcttaatttcaaaatatggtgcacaaaatataaggggaaagggttaaattgagataatccggtgtcattttaaagcgaacaaaattgattttttctaaaactaaaaatcaagaaacaaaatagaaacatatcaaataagacaacaaaagtgtgtaacgtgacaatgtgatataatacgaaataccctaggaataattgaacacataaaattcactataaaaggacaatgtcataattaatttttgtaaataaaatattcaccactttacatgatacgtaattggtatttggtacaaaatttgagtaatagtaagataaatgtagtagtagtgtggtacttactatggttatgtctatatatacatattgcatatgtatatataaaaagattgaaacaaagaaaaaaggggttttgtgcttttgtaagtttgagaaagaggaaaaagaaaaatgggaaggggtagggttgagctaaagagaatagagaacaagatcaacaggcaagtgacctttgctaagagaagaaatgggcttttgaagaaagcttatgagctttcagttctttgtgatgctgaggttgctctaatcatcttctctaataggggaaaactctatgagttctgcagtagttctaggtatattcaaatattatttatctatcttgttgtttttgagatctaaatgagtaaaagatttaactatttcttttttatatttattttgtatgtgtgtgtagagagtaaattttccatttttgtgaatattttggagtgtataggactttgtgcttgtaggtgttgttagatctgcaagaggaaatcatgaaaagaagataaaatttctatatctatgttgagtttctcttctcagtcttccttgttagtctcctctattttgtgctcattttcttcttctttgacctcttaaaccaaacaactcatttttttctctccatgtactgatctataaagctaattatatctcttatttctttgagaaaatttcatcatcaacaaatttagggttcactgttcattcatcaatatagattttggttggtggttttcacaaattttgcaattttagggcttttacaaccctacctttatatgttattgggatttgttttgatcatttacttttgatggaagctcatctttcaaaactttgataattttttttctttcttttcttaatctttttcaatatttaaattttttatttaattattgatctttaaatcagttgatgaaacgatcttatatccggtttcgtaactagatctttaagaaaagaaagtagatctatcagaattctacaattactggatttgtgtctagatctgactaaaacttttgaaatagataaattgtcaagctgttttagagatggaaaatgaatatatttatttttgtaagaaaaatcaaataccgttagataatttatttttttcgatttatttgtttgatgaaatgaacaacagcatgctaaagacgttggagaggtaccagaagtgcaactatggagcacctgaaccgaatatatcaacacgagaagcactggtaaatgttaatatttcaacttctttcttcaacagttagtgagtattcttgctttattacgacataattaatgtgtaactgctgttaattataacctactctagggtgagaagcaataccctatctcattattttaaaaagaattatagggtttgaaatctatctaataaggtaatgaaagagattgactagactgctcggactcttcaatttcaatgctcacatctatatatgtcgatacgatgtgggtgtgggatgagtatccaatctggtcaatcatttttggttactttgatcatattcgagagagaaattcttgaaagattcaattgtttcggtaatcaaaacaaaaactaaggttaaattaaagaaaatgaatatcttgtatagtaaaaataaatttgtactctcactctttttccttttatctcctttcttcggtctagatcattattttctccccaattttcctcataataactcgtaatttaggtttaggaactctatttttagaaatttaaattattaattgaattgcctcgacctatccatatatatatatatgttggtatcacaaatcataaaatttagatcatagaggatccaaccaaaacactcacacccaagttcaaacaacttaaatgataagtgagctagttgttaatcaagatatcccatccatatatgatgtgttctccaaataagtgggtcaaagttccaactatcttttcttttgttccatatcgtctttgagaaattgaagagtccgaacaacttagcttttcttagaaattgcataagtttgtgcaaacataaattacgtcaaattacatgtttgcgtaattaatgctagtgaaaaaatttggggatccaacgaaaacagggaacaggataatataaatttctttgggagctctcagataaccaacaagaacaagctaagtgcattctctaacgtaacgtattatacggatagttaattgattcttggcaagtaattcgtaatcattgaaaacacattggatcttatgaagaacaaatcatgtatttttaatgtgctttgttatcattcataatgaagtgatggtaagtttaattattatttttcttaaaaggtgaaattttcttttagacagttttgtgatttctcatattttctactatttaaattgctatatgtttcatttttagttatttaaaaagactttcaagaatatctattgatctgcataaataataattgtaaatttgataattgatcttatcaataccacttaattaaatcagcttataataattcaattttctatattaatatttaatactcttcaattggttttaagaataaaataaagcaacaaattaggatatattgtctttgagtcgtggaaacaacacttaaaacacataaagttaaactatttacatcagactttgtggtgtgactcttctttgaactctacttacacaattagtagaatatttgtgaattaggttatccttgtatatagctacacatcctagtttaattcgttccttagtaaaaaagagactttaattcaaagtcagaatataattgtactctaaaaaagaaaatgacattctaataacagcaaatgaagaaatcaattgtttaagaagaattttgtatgaatcgcaataaaattaagctcaaaataataataaaaaaaaacaagagaaaacaatgtagaataaagtagaacataattatcttctttatttatttatatttatagtgttacaaaacaaagttgtcataacatagcattaataatgacaattataagatagaaggcataatattaagggtttgaagtcatggaagacgtggaacataatatgatgaagaagtagtggtaaatagagagattacatttattggacattcatatacaaagtatattttatattacgaataaccttagagaacttttcaaaggcctttttattgagatattttggagaaacaatgaaataagtacattaaaacctctataacttaatgctcgataaattaataatctctttaaaataatattttttcgattgacttggatcaatggaaaaaatcatcaatttcgattagataataaaataaatattttgagaagactcctatataaatatatggttccattaatatcataaattaataaaactgttaaaatacaaatatatttaagacaatttaataaaatatgattctactgtgttcagtttttttttaaatttgaatttagttgaagctcatccctactttttcttattgcatctaagagctttgatgttgtcttttttcgaactgcataataaaattgtgaagaattctaaatgcgataagtgtttccttacgcgtaactagtttcaaaggtatagtatcatcttcaatgtcatcatcaacattgtttttttatagtatccataatttcttctaaattttggacctatgaatatgtatcgatttcacccgaatattgacattcattttattgtagtaactgagatcattaatcatgacctcaagttcatgaatgacgttttcacaagtgggttcattcaaattctctaagattctatctcccgaacaaattttacagtgtcaacaataatttgatattttctcttgctgaatatttattgtccaagtaaggactgcaaaattgacaacatctaaaacaataatcattactagattagtttgtcatagtcttctaatattctagataaactttgttacaataatacatcttaaaactcttattactttagcatcacagtgttgaaattaataagatacaatgattttgatataatcaaaattaaccttcattaagtctcaaatcattctttaaagtaataaatattaatttattgattaaataatatctttacaaaataataaaatttcatggtcccatctatattaatttttagaggttttactttaattctaacaaaattcaaattttgtttatttgttgggtatatgtttatattacctaaaagataattaagtttgttatgtcaaatttgtttgatgataaaggtagttgatgatttttttaaaaaaaataaaaacttttaaattatgtaattttattgatacaaaataaaaattgaaaaataaggggaattggcaagaacaagataaagtttttttttttggttttccatccgtgttatccatattggagagaattaaacaataataattgtaaagtgctaagcaattaacaaggcaaaaaaacataataattgtattactgttaatggtgataggaaattagtagccagcaggagtacttgaagcttaaaggacgttacgaagcattgcagcgatcacagaggtatttagaagaaagcatttcatttaatttgttaatttatcaactgcgttttcacaataattaactagttatttcgatgatttgtgaataggaatcttcttggtgaagatcttggtcctttgaacagcaaagaacttgaatcacttgagagacaacttgatatgtcgctcaaacagatcagatcaactcgggtaaatattcacatatacatacatacatatatccctttagatttgttccattggactgaccactagtttccaattttatagactcagttaatgttggatcaacttacagattatcagagaaaggtacatatgtttattttaataatatctagctttcaacaatatgccttgaggtagtattacttttggtatcaatgtaatgtttctttaccaaaaaaaaaacttttgatattttcttcttatattcattgcgatatggtaacctttcatatgacaggaacatgcattgaacgaagccaacagaaccttgaaacaaagggtacgtaggtgcatttttccttattctcctttcttgataatgcattgaacatttgaaaaaatgtgtttcgtctaagttcacgttggatgtaaaaaacggaatgagggtttatatttttcttctttcccattctacgctatgtttgagacacaataacatgttctggaggtgaataaacttctttagagatacaagtgactttcttgagatagtaacgtcactctttcctttggtttgatcaaattcctgactgaaaggggtattcaaaactacagtacatttatataatctaaaagaatgtcttctggagaaggaccttggggatgcaagtatatatatagagagagagagaaaaacattattgatctgtttacttcctcgtttaataagatcgagatgaggtatgaccttttactaatagcttacattgggatagatgtcaccaaaagaaccaatatctcatgtcttggtcatagttgcttcaaaagaatatgaagtattatatgtatatttagtactaaatatttaactgtcaacttcattttgtagttgatggaaggaagccaactaaatctgcagtggcagccaaatgcacaagatgtgggctatggccggcaaacaactcaaactcagggcgatggcttctttcatcctttggattgtgaacctactttgcaaattgggtatgtccttaactttttggaacatatctttctatttcaatatgtttgagaagataattcaccacccaatgagggacaagaggagtttgctcagatgataagcatacgctaactttaactttatcaagttattaaggaagcaaaaaggtagtaattcctagaggagagtcaaaacaatccaacaaatagctaaagtcaattaaactgcattgagtgaccccgtattaagttagctatgttgcatactatgtgtctatgttatatgaatcgatcatttgtgtgacatgcttcatgtatattttctgttgagaaactaatcgatagtttttttgtttttttttaaatattatggcaggtatcagaatgatccaataacagtaggaggagcagggcctagtgtgaataactacatggctggctggttgccttgaaggctcacgattctgatcataacattattataaatatgctcaatggttttcctatcatcataaacattgaatatctcctaatttctgtatgttgtttgagaaaatgtttcatcctggacctaacggggatccataagacaatcccgttattgttagtaaatcataaactagatttctttgagtgcttaaccagttgacttatgttcctccatcttctattctttagttgttgctatgtttgagtctaacgtcacaatgaacagagacaagtctagtgtacaatgtacactagccggcatgctctcgagctatagttccttaggctcgtcccctcttatgagtggttctcacttgtgtgaaactggcaatagaacgagctagtcacagtttagctatgtaattagacagtagatgttatcttgatatttcaatttctacggataaatcttaatcctgggattccacagattcacatatagtagttgaaactctatagtatgagtattattattatttgttaatatatttctggttcttactcactgtttaatcaatgcaattacagcctcccccaaaacaaaatccaaaaaccaactccctcatcaaggctcgacaaacaacccacaacggtggtatgttgtcagtaatatttaaggtggaatactattgagatgtaatggcgtaagtatacaactcgaccctagttggtgtttggacaaaatgataattacactcgggataatatcaccttaaatagcaacagaaagaaagagagtaacaagacatcatctaggaaaaacaaaagttctttaactaaacaatttagagctacataaagacgaagggaatactttgtagaagagcagtatttattaatcggaaatatctgcctttataggcttacaaacgcaggaagataatatctatcatgattcctactagactagaaactaagaaaggaccataaacaatatcaacctaacaaagactctttcaactctagtaaaagacttattcaactcacagtaaatgatttattttacgcggtgacttagactcttttttaaatcaattgtcaacactcccccattgattcaaaatcacatacgttaaggcataacagaaagtacttgtgtttgtgaaaaactaaagttgattttttggaagtacaaaaaatatcatagatt

SEQ ID NO: 376 - DNA, 5779 bp, Solanum lycopersicum
aggtgttcaataggtaatagtcacagttaaagtgtctatgtgaaatatgtaagcaatttaaggggttgcagatgactttgacctgaacaaaatatagggcaactttcacatataacaaacaaaaaattcatatttgtatgctataggaaagtttggaaattgcgctccatatcaaacataaaactgtataattcgctatacatatataattgtataattcgctgacctatttcgctgcaattgtataatgcacaattgtataattcgttgcctatttcgctgcaatatttttataaaatttgctttgcacacagttgaatcgaattaaaatgtatgtatattgcataattataagtgtataacaagaagatatatgtttttctctcgctttatacaaaaacagaaacacattatatacacatctgttgtataaagctagagaaaattgtatttcactgcaattttataattcgcaattgtataattcgttggcctttctctctgcaatatttgaagtaaaatgtttgtaaattgtatgattaagtgtataacacgaaaatatatatttttgcatgtgtatatacaattttctctcgctttatacaaaacaaaaacaaaatttatacatttatgtgtataaaacaagagaggagagcaagaatggagagtggcgagcgagatttttgggaaagagacgcctgacaaactttagttagcgtttgctatgaagcacaattaaatcaaactctagctactccatttattttaggttattagtttgctattatatataattttccctaaaatatattagtaacgcttacatgcttcatacgaaaaataatactctcttaaataaaccaccttactaattttaaaaaagttttttttttaaaaaaagccttaggtaatggtgaatagagagttgtcttggtcaaagaagccgacatcacacgttaaacagtaatgataatgcaaggcagagagactttcacaaaataggcaaaagcttatagtagtgcagttgctacccttcaatctttcttttcccgatatagtttctctactaacccaccccatatctcttcactttttcctctctttaacttcaacaatgaacatgacccttgttgattcacctcaatttctacttcttcaaaaatgggccgtggaaaaattgagatcaagaagattgaaaactcgacaaacaggcaggtcacttactccaagagaagaaacggtattttcaagaaagctaaagaacttactgttctttgtgacgctaagatctctctcatcatgctatcaagcaccaggaagtatcatgagtacacaagcccaaacactacgtatgttatgttctcaacacaaaaaaatttactttattgaaatcaaaaagaggtttaatttttttttcctatcaggacaaaaaagatgattgatcagtatcagagtgcacttggagttgatatctggagcattcactacgaggtataattttagcgttgattttgtatactcttaccctagaaattgaaatcagtttgtacattgaatttatgtgtacagaaaatgcaagaaaacttgaagagattgaaagagatcaataacaagctaagaagagagataaggtaattattttgtatccgttactgttctgtactactctgcatatcattcatgttacttcacccatatttttattccctttttcaaaactatttgaaaatgctttatgcttatgaggtagggctaagatatgtgtgcactctacccttcccctaaaccctaaccctactggtggggttacattgaatatgttttatattaataacacagtttttaactttctaatttgagcaattgaaggatggttaatgagtcatgtgatcagttttttttggtatgtgtaatcaagcaatgataatgaaatgtctgatgttggtgtctgttgataggcagagaacaggggaagacatgagcggactaaatttgcaggaactatgtcacttgcaggagaacatcactgaatctgttgctgagattcgtgaacgaaaggttattgttcataccttactctttacattttttgggttatgttagtctagaataaattgtatccatttctgaagttaaatggacctaaattaacttaagtaatcaggatatattcttttatcaaaatgtgaaatagtgtatgttaaatgttaggttaaattcactttattttgagtcttgagaacagaaaagtgttcaacatttatttgaagtataggcaatgaatcttttcagcttggaccaatttaatttaaacattagtgaatacaacaatagttcttcaagctggtcttgtttctacttgccaaaaatgcctataacattttgtgacaggtgaggattcaaggttagactcaaggttatttgtaatacgtttaggtccaacgaagagtgtctgggtgtctaaatatgaatttataaaagtcatgaccacttctatcacaaaaatgattatgtttgaaagaattgctactgtgactaattgataagtcgacttgcctaaattaggtttgtcactcttagaattcatttcagttgactaacctgagccagtccagtaatctatgttcattttattagtgatagagtgatacgtagacctactagaggcaggtttgtcactggcaagattttgactggttgacttcatatcgtgattggattggttagatctgatagagctatgaacaaaggatttgtgcatgctattaacttgcatttgcaattcctaaatatcttcctgaagaaaaaagtattttctattccacatacttgcaatcttatttcctactctttctttccaagaataagtgtagagctttcacatgcagccgttgagtaagtcttcatagtcttcaattggtcttgattagcttctagagttttggaaagaaataggtgctttgatacttgtttccatagaggccttttgattactgccttgagatcttgagctttaataagtgcagaatcttgttattcagttttgctctctcgagatgattccttctttaacagatgttgattgagttcttcccatacagatatattagcatatagctattttactcgacttcccttcatatgcttctatgtgttaagctgcatgatcctgcatacatagaaagcacttatattaaactcgtcatcataaaattaattaaatagaagaaaccaatgcttcaacccgttgagcagcagcagcattagtgtccacaacaattttcagaacatctgcttcaacccgttgagcagccgcagcattagtgtccacaacaattttcagaacctctccaacatcataatcacaacacacttcaaataccttctccgtaagccatgtagctagtttgtgccacacacaatgcgtgacacacttgatctttcaaacacagccctctgctcaaccctcaatctccacaagcccaaatcattgggctttcacgcaacaatagcaacttgtacacccaaacattcactaagcttaacaagcctttaaaacagttggcgacactacaactacgttgaggcccaattctagttttgttgaagcagtatttcacattgcatcataagaaagctcatttagaactgtgtaagtcgggggatgataccattagggcctgttgaagaggcttagtacaatctcaaaaatggtctctgtctatgtaagtggtagctatggagtgagctaatgtgctttcttctgtacctggatggccttccattgctataattttttgtctcgctacaatattttgctcccccattttgaatcagtacttggtagagaagaccatttaaacgaaaagaatagtacagtagtaatattttggtgactcattcatgtaattgatcatatgataggtcaatcaaacttcgctttggtgttctttttttgtgttttacatcgtcagcaaatgaaattagaattagttttccacatgtattattgacgtacttaactataagagtctctctgatttcctacagtaccacgtgatcaagaatcaaacagacacctgcaagaagaaggtaagtttttcattgttaatattttatatgaattcctttcttttcattttgcctgggcattttacaaagtgcaatgggttcttctataatgacaaaaataggcgaggaacttagaagagcaaaatggaaaccttgtacttgacttggtaagtatctctttataaattcagttcatatgctgatttatttgtttttagttgattaatgggggttgtttactaacacaaaaagtaacgtaattgcttcatcaaaggaagcaaaatgtgaagatccaaagtatggtgttgtggaaaatgaggggcattaccactctgctgtggcatttgcgaatggagtacacaatctttatgcttttcgcctacaaccattgcaccccaatcttcaaaacgaaggaggatttggttctcgtgatctacgtctctcctgaagatatcagttcacagtaatggcgttaaacattaatgctgagttacttattcaaatcaacttcccgaattatatcttattcctaaaaaaaattaaatattgcaagctgcaaacactactttatctaactaatttgctccgagtctggatttggttctgtgttaagcactctattattctaggtgtttcaactcctttctatatatgaattatgatgccttgaacgcatgttcaattaatcaattttccttttcgacttgattgttagcagtccatatcacttggttttttttagaatgttatgcaatatgtatcttcatctgtgaatctagttcttaatatttcgtcatcaatggagctaagctgttaaatttaacttaagatctatatagctctacttaggtcattctcaatcgtcttctgactcgtcaattttaacctgtacttgttatcttagatctattaccgattattaaaatgtaggcttaagtcatatgcagccccttgaagttttcgcatatttcatttgaacacctcaacttatctttgctcctattgaatactttatttgttcaaatgtaattcctattagagacaaactgctgacatgtcaaaaaatgtataccacgctttctttgggcgcgtgaaactattgaaaataatattttttttattaacttatatacaaaaattaataaaagggaaaaaataatttcttttgaaaatgaagtcttctatcccgcttcctctgccattttcatctaccattttcataattttttttacacatacacagcgccattttcatctaccattttcataattttttttacacatacacagcacaccctaccctcttcacctatctatttcttttaccgtctccaattcttcttctgcttttttttttaaatgtagatctacatatttaatattccgataaaataaatatggattaaattttttttcattatttattataattgcgataaataattacaaatggaaaaagataaatgcaatgaattgaaggttttgatgatattaaaataagaaagaatatgtattttagcttgggtggatggttaccgacgttgatgaaaggagtaagattcgatggagttaaaaaagatgtgagttgatcaatggaggagaaggaagaggtcggatgatggtctactgggttgtcggggccggcgtcggcgttgatcgatggaaggcgttaaaaaaatattttggattatttaaataatatttttaa

SEQ ID NO: 377 - DNA, 5295 bp, Solanum lycopersicum
ggttcctaatttcacgaaaattcattctctacgactcttccctgtgcttgtattttttttttattattattattttacaagatttttaaaaaatatttagtattgattatctttaatatttaagatattagaattaaatgttactttttaaatagaataaggttaaatattttaaaataaaaattaatataaaatttatgtcacatttaattgacgatataaatttttatcctaactaaattaaaagaataaaacttgttcaccatggccatagcccataggtagaccctcttcaccacacaaccttgaatttccttccaccttctttgccttttaagttgaaaatgactttttttataaaaaaaaattccaatttatctatagtaatttcatttatttatttctcaaaatataaacttttaattatattgctttttatctattccaagatagatttattttaaaggaagctgtacaaattcattagagattaaatatttaaattgtgattctttttaaaagtaaaattactatttgaattatgtgttcagcagatataaataaatttatctagaattaagttagtaaaaacttataatcaatcgaaagagtaattaaattgtataacagaattaaaacgatcataactcaaatcgaatctaagtcgtcttagtgctatcccaaaaaagtgctaagaaatgtctcatttggaatatccttctcactcgaactcattacattgaatttacttactaaaatttataacttttttgtatactcgatttgtatccaaaaagtaataataatttatcatttaaaatttaaattttaaaatctttaactccgaaataacaagcatcttctttttttttctttttctttttttgttaattataaagaataatatatacccaaattccaaaaacatggggtaagtaaaaaaagataaaaaagtataggcagaaagtgtatataaaaaaggaccaataatagcattttcttctcacatcaacattcccctctttgcctcttctgcttcttcaatttcaaagattatttgctgactcaaactctctttttttttctctaaaaaaatttccttcagttcccctctccctttttccatcgaacttatcgcatcgaatttacttagtacgatttacgtcacgtaaataatggaaaacaatcaccagacacaaattcagaccactaaaacatcaagattcaaacgcatatgtgttttttgtggaagcagtccaggcaaaaagccaagttatcaacttgctgctattcaacttggcaatcaactggtacggattctacgagttcaactgaattatgcatacatatcataaatttttaaaatttatatactttaaattttgaattcgtttttttcatttttcatacgagttacaattgcatgaaaataaatttaaacttcaaaaacaagaccaattgtcctcaaatcacacaattcttttttcttaatcgatcagataacaaataaaaagaaatcacccagataataattcttttattttatttttttcaattatactattaattataacacaaaataaacggaataaaaaattgtaattcacgttggattaattaatttaatgttacaaaattttaataggtgatgagtaagattaacttgagtaatttttttttagttaattaaatggggttcacgttgaatataatggagtaagcaattaaaacaagcaatgttttgtcctaattaaaaatatattttaaaaaaacacttgtcataattaaaagttaaaactatatattatattatttggcaggttgaaaggaacatcgacttggtttatggaggtggcagtgtgggcttgatgggcctagtttctcaatcagtttttaatggtggccgccacgtgttagggtatctatttttttaaaaaaaattgacaatttgttttaaaaataaaataaaataaaatcttctccattaatgtaaaactcattttttaatttctttttcccacttgacagggtgattcctaaaactcttatgccaagagaggtaatttttttttttacctttaataataacaacaaacatttttctatagataattatgttaacaaattaattgtgactagtatgtatatttggatatattaataatgcatctaggtataattacttgtacttaatttttatcgcagtcaactatatactagtcaatctaattagactgtgataatatatgataacttataagtcaaagtaagtaaagtcgttaaaatagactgatctagttcatctcggcactcaatttgtaagctggataagcctattttaacggctctaaatactagattctttcaaaatacgattcgattttatttttttaactctgttttttatgatatatattttgttaatatatagattactggagaaagtgttggagaagtaagagcagtgtctgggatgcatcaaagaaaagcagaaatggcaagacaagctgatgcattcatagccttaccaggtaaattaatttattaattagttaatttttaataattttgctaaaaatatttttattcttttataaatcttgatttttaaaaaagttattacatcatagccttttagttgttgtcacatgtatcaatcaataaggtaagttgacaacccaaactatgtcacagagtattgaaatagtcaaaaacatgctcagtcaattatagtttaaaacagatcgagctagctgagcagatgataattcatcctatagagtttatctagtgtagtttatgcttattaataatgaatttccttaattgcaatgctaaattttattaatttttaattaatcgttaattaagagacaactaatcgatttattaatttttttgaaggtggctatgggacattggaagagctcctagaagtcatcacttgggctcaactaggcattcatgataaaccagtacgattacttgtcttttactcatttgtttttattttatttaatgacaaattaggtttaatcactaatgactaatgatatacccactattttgcttttgtcttattaataagcgcgtattaattagtaaattactgtgtctgattgcgaactttaaaagacagataatatagatttgattcagagaaatttcgttttaattaaagtaggaccataagaattgtttctctaatgtcaacaattaataattaatgtaatttaagataactaatttaacgtgtgttttacgtaatatgcaggtaggtttacttaatgtagatggctactataattcattattatcatttatagacaaagctgttgatgaaggctttgtcacaccctctgcccgtcacatcattatttctgccccaactgcccaagaactcatgtctaagcttgaggtacaactcatcattcatcggcacgatattacgcatttactgacttaaaatcttgaactcgtgaattcatatcatgcatccaccgacttaaactctggtaaaaatattgaattagcgcattcttagtattttgagcttacaattcatgattcatcaatgttcgtatgatgatactgtgcatcttactacttaaaattttgaaattaacatctcgaatttactattcatgattcattgcatacatatggtggttcattgatttgaaatcttgaattattgcgctcgtatgacgttactattcatttactgacttaaaatcttgaattagcatctgttaatatctcgaatttacatgtttgaatgatttttatttataggattatgtaccaaagcataatggggtggcaccaaaattgagttgggaaatggaacaacaacttggctacacaacaacaaaattggaaattgctcgttaaatattcaaatgatgggtagatttaatatatttatagagaaaaaatgtagtaaatttctttgaagacttaaattcaacaattatgacttaagatgttgaagggaaaaagcttcggagaattaattaatatataattagtagctttgcagcactttttacttgctgtttataattagttttaagggggaaaaaatatagtacgtaattaatttgtttagtgttgattcatttttgtccattaggctaatcaaatgcctaattaaaacatgaaaaaaatgatgtagtacaagttattgttttttttttctgtttgtatatgtttgtttgttaagtacattattattctacagttaattgtgtttactctaatgtaaaacgtgtaagcttattttatgaaatgaatattaatatattttggaacaaattcttgttactttcatttggtaggaaggcgttcgattattaaattttcttcattgaaaaactacacgagcaataaagaaaaaagtttgtttttttggttgaattgtcttgacatatgtaaagctttagtatagcgtggatggattaaaaaatgatttagatcagaagtttaaatttcaagttgggatattctaaaatgttatatgaatctttttattataatatcatatgttatcgttatacttgagtacgattatatttttcttttattaaatatgagattctgagagagacacataccacatgatttatgaggaaaaagtaatgttacatcaaggtccaaaaacttaggcaaggaccatatatgattgtaggtaagaatatttttatttacataatacataaaagaacaagttaattttggactttctttttttataagaaaaatactagaagagggattttcaaagtccactatgaaaagtagaaatcaaagtgtaaaaaaattattggaaagttgaggatagtggggctaagtctataaatagtttctcccaaagttgttctcttgcatatggccaacatgtatatacaaatttaggtggaataatgtatattaatttgggcccttgtattctctcctacttgctatttcactctcctcaactttcatatatatatatatatatatatatatatatatatatatattaaaattttatgagttcagataaaccgttgcatcgaaaaagagttacgagataacacaacatgagatagtgttccatctttcaacttttttaacatatgcataatgttgagtgcaccaaaatcagaaacaagataagggtacaagaaaaaacagttatccattttgctaacttagttggtatactgattgaagcccaacattaaaaaagtgttctttttgttcaatcatgttcatattttgggataaccttagcttcatagtggaatg

SEQ ID NO: 378 - DNA, 6572 bp, Solanum lycopersicum
gactctcaaatcaaaaatagtgtaatcgagtatgatttttcaaaaaaacaaaaaaacatcaatataacaatatgagcgaaataaactaagtaataggcattgtaaaaaaggaagaaaaagatgcttatgacttatctccgttactgaattggttttcctcttctccctaataagcaaagagccaaagactaatattgaaatgagttatttcctcatatgatattcgacattaatcctttcatcatcaattagttttttcgaatgaagttagactcaaaatcccttgtgaaactttcaaaaaattaggtttatgagttgagttggtttcagaatgctaaaaataaaatgcataatacatatattgtatcctaaatttggcttcaaattttaactttgacctctaactttcataatgcacaaacaaacactttgactatctaactttcaaataaataaacacatgagtcttacatgacaaaaatatacatacgacaccacgtaggacgaaaaatgacatgtaagacatgtgtgtctatttgttcaattttatacaagtttaactgtttaagtgtctacttgtgcacacccaaagtggaagggcataaatgttatttgaagtcaagttaaagccatacaaaataaaaattgaattatgtcttatttaagatggataagtagtttagctaaataaatttttgttagtaagttttccatttctataaatttacagtgaagaagtgagttatttgcttacgcatgatatgtacgtaatatccactaatacaccgacgcgtgtccagccaatttagtacacgcctttgttctttcactgatggaccgcacaaatgagaagcaaaagctccaacaaactaaccaagcgcgtgtatcccagacaacgaatagttgttgtgcgtgtactccacgcgcatcaacagaagcgtaagactagtccctataatgcattggctaaatacatgaaacttgaaaaagtagtggaaataagaaccaaccctaaagctctaaggtatctaaatttggagtacctaagcaaatcctaaagttaaaacaatgaatccctaaagaagataggaagaaatgccatagataaaaacaacccatgttcactttttctctctctaaacattgaaattcaaccaaaacaaaaaacaaaagttgataagaatcctttctttctttctttgtgtgtgtgtgtgtctagctagggtttgcatttctttcacaattttggttgtttcagtaggagagaaaagaggatctaagagttagccaagagaagaaattagtgagaaaataaagtagaaaaagatcatcagaggaaggagggatgggtagaggaagagttgagctgaagaggatagaaaacaagataaatagacaagtcacttttgcaaagaggagaaatggattgctcaaaaaagcttatgaactatctgtgctttgtgatgctgaagttgctctactcgttttctctaatcgtggaaaactctatgaattctgcagcacaaacaagtaattttttttcttctctattctaagatctgaaattaggattgaagctctatattatcaaagatctgttacatacaacatgaaaaatcatactcccatcctaaagttgttcataaaataaataaaacatatagatcttatgttttagtgcgtttctctaggagatcacactatttttgtttccttagtgactcgaattcacaattttagagttggagatggaggttttttatcatccgagcaacctctcgtgtcagatcctgagttttaaaatcgaataaagtaagaaaatgcacttaatattgtttagatcgatcattagacaatctcttcttataaagaaaagagtaaatggaccgagtataatcgtacctgcagatctgaataaccagataaaacgtcttccagtccttaattctacgccttttttgatgatggcaaataagactgatatgataaaagactcataatatcctgtttttacctctgtgatcatagacatttgtgatataaatcagtccaccgggtatttctgcgtgcttcataaagttcattcactttaaaatttatagctaaatattgactttaatttataataatatatatcagttcaaattttaaggaagcctaggaaatatcttttgggtaatctcatgacatgcatatatattttttttttcatccgtgaagcaaatttctatttagttatcatttgagttgtgacttctttaatagaaagactgtaaatttaacacggtggggaaattgtatagagtacttggattagtgtagtagtcaaaaattcatgaagttgattgagtggccttcaacttaacatatacggttaaaagaatttatgttatttatatcgttagtgtaaggacttatcgggtcattaaaaagatgtgatcattattgaatatatgcataatcttaaaaataaaaataattacaatatacaacaagtaaatggatctaatgaggaagttaggtacattagtaagtagcatttacttcatatctctgtgcattgaaaacagtttttgaaactgttttctaacaaggattatggctaactcaagtcaggttggtaatcgtagttttagaatatgataaaaaatgattcattggtttacaataagtagaaattatttacattgtttgtccatcatataaatgttgatccaaataattttacaaagaggcgtagattttatccttaattatctcttgagtacattattcgaacatgtttaatattttcatcccgtttatagcttttgcatggccatatagggcaggcaaaatgtttttttttttaaaataaaaagagttgcgagctagcacatttttttatccgtgttaaataaagatggatcgaatatttatttatacttgctcatatttgattcaatccaatcatttgagtattaataactttttcctttttatttatcttgtgcaacagtatgctcaaaacacttgataggtaccaaaagtgcagctatggaacattggaagtcaatcgatcaatcaaagataatgaggtaacaaatgctactaatttcgttgacgtcaccttttcaaaggatgaacgtatgtatgatttttaccataatataacttactatatgtaagttagttgctttaatttctgacatgatcgaatgctgctcgatcacaattttttctgatcgaatttttttcgcaaataaaggaagaatttttttttttatatatatagacccttttcaagttattgatccatcttgtgagccattgcagcaaagcagctatagggaatacttgaaactcaaagccaaatatgagtcgctgcagcgatatcaaaggtaattaactactagctagaaagataatctataggtgtcaaatgaaacctaaatattagtgacccgttcaattcgtccaaaattttattctcaaacatggttcaagaatgggctaaatcataacacgtttagtcagaatccatttgccaacttaccgcagtttttatgcccaaattaacccaactttcgacttgataatgaaataggcgtcggtgcagttatgtgatcatcgcgaaatgtcatcagtttctatgatactttagtttctctattctctctattttaattttttttaatgtttagtgtcgtctaaaagcactaaataaaattagatatattcattttttagtttaatttgactataaaaaatatttatctaaacaacagtctagtaacattttattaaatccaaaactttcgatatatttatataatcttttatgtactatgtggaggtttagagtatcaccaattaacggtgtttatgatgctattaatttcaaaataaataaatataacaaactaaataagcttatataagtgacatctttggacgctctagtcacaaatattgtattttctggcttttctttttgttgagaaattggtttgcctttattagtttggtttataaattactctggtatgtaagtattattcaaattaagtgagtcgggtcatgatctaatccattatttttgctcagcacatatgcttttagttggatcaattatttattcagcccatttaaatccgattatccatttgatacccctatgttaaccataatcatgctgtctaaattatttgacatagaaggatgtacacaaattgtattcttgataacttattatactttaacagacaccttcttggagatgagttggggcctctgactatagatgatcttgagcatcttgaagtccaactagatacttccctcaaacacattaggtccaccagggtaagcttaacttataacaaatttttagaccaatttcaattcaagtattctgattgttatcttctggctgctctatagacacaaatgatgcttgatcagctttctgatcttcaaactaaggtattctcatttgattctaaaatggtcaacatgatgcatgtgttcaatagttagtaacttactattttatcataacaggagaaattgtggaatgaggctaacaaggttcttgaaagaaaggtaggttgcccatacatgtgattctaactcattttctagctccatgtatattactagttgtattgtgattgatttttgttagattaggtttatttttcgtcaatttttttttttttacctaactaagttgctaaagtaaagtatttctgttgaagagtctcacatcggctctttttaaggaatgggtatatgggaaattgtgagctagtttttagggttcagtaattattaagccgaagatcaatattccttattgattgatgtaccaaagtcattgaattgcatataatttgttagcagatggaagaaatatatgctgaaaacaacatgcaacaagcatggggtggtggtgagcaaagtctcaattatggtcagcagcaacatcctcaatctcagggtttcttccaacctctagagtgcaactcttccttgcaaattgggtaaattctaccatattcattctatatatatcttaatttttaatttatcctatctattttacatctgcccattagttcacaagtgagattttttgaaaaaaaaaaggaagaagcaaaacaaatatagcttttcatactctagagatatcgatgaaagttattcacacaattaaagtgcttggctaaaacaaaaatgttattgttttgatttaatgcaggtacgatccaataacaacttcaagccaaataacagcagtaacaaatgcccaaaacgtgaatggtatgatacctggttggatgctgtgaatgaaaaagtcctttatcttcagctttgcataaaagcatatgaagtatatttctataataataaaggaaaactccagtacctttattttcagcaaaataccctaattaaggtgaacgttgtgaaccattttctttgcataaaaacaaacttgtttgcttggaaatgttttattttattcaaatcataatgtggatgttgctgaatatgatgattattagcatctttcatgtgaattcagtttcttttgtgtattcaggtacagagaagatgtcaaaattttttaccttcattcaaaatgacttctttagttgaagtaggaacaacatttcacaatcagcattccaatatcctccgctcttcactattatttttaatctctcacaccaaacgagtcctgcccaatccttatatctcctgctctcaccccacaaccccaacccccacaaattccccgtatttgtctagctagataatatgtaatattttattcttttagaataatatatattttttttcttataatttaccatatcgaacacaagaataaaaagtggagaatcccacttatttttcaaaaaaacatttttgaaaaactaatagtatatgataagttcaaaacttcctaccaaacaacacttaaaaatattccttggcaaagttttccagaatcgatcgggtcatttaaacgcttgttggaaagtcgtagattgaaacttttatctgtataacattgtaactctatatgaacaagaaaggaaatattagtcgcatgatatcttttaataaataattactttttatttattattatttataacagtacataataatgatatgataaatctgcaatatattaaaagtgaattatgtatgcaatatatgtgtattgtaactgttttaaaatatattatgcttgtttgttaagaaattaacacattttactaaaatatatgataaatgtattatccatcaataaaacttgtaatatatatgttttataaattactatatttgtaacatgtattaaaactgtgataaaagtattatccatcaataaaatttatattataagtgttttactgtaatatgtattaaactatattataaatatattaaatgtgatcaagtgaataaaaatattattgctataaatgataaatattcttttatgatattttaggtaagtttcctaagatgaaattagtcattgtcaatcacatatcaacccatttgtatcgtga

SEQ ID NO: 379 - DNA, 2551 bp, Solanum lycopersicum
ttatgtcatagttatttatcatgcccaaggcaagcacaggactgaggaagaatacaggcagctcggtcgagctgccagtttcactgactgtaagggtttttatatcgatcatttttatttacgattcttgaatttcacgagtaatgaatataattgtgagttgtacgtagttctacgtgctaaagtgtttcaaattaataattaacatgtgtgttgttgtacaataaaactctatttccaacctcatatgagtatggaatatcaacttgcctttaatatgaaaagacaaattagatttgaatttaagaagtgaatgcatttaattttaaattaaataatatattgatcaatcataatatgtcacgtgactatttaaattataaaaaagtcattaagtttatagcattagttgaaaaatatttgtaaattgtaaattcaaaaatacataaataacatatatgatccattttctatacgttaagaatactattaatccctttacattaaaataattaaatgagccaaaaaaataataaaagtatcatagaaaaatgagatgtgtgatgtggagcaaaggaagtgcaaatggcatatcctttggaagatcccatccaatgccaatattccatttcactcttttctcctacttactttttggtctaactttactcaaaagtgacaatacactacctgctcaagtcaccttgcttttttttttttattttaaagcttaattattttatatttatgttgaaaagttttatttttagaattaaaatattttttatcgggataatttcattttcagagtttggatgtgagagttcagcaaaattcataaaaattacttattacatatagattatatgccttttttttttgaaaaaaaagaaaacgaaaatatcataaactcaaaattctaaatctgcttcgcttcgccaatataaaatataaagtattcttattttttattgtcatcatgatgtaggacaaaagaaccaagtggccactcttataaacactaagccatgccttgtataacaaaccctctctcccctttcatgtgaggcttcctttgcatggttttactagtgggcaaccacccttttgccaccaacttttagggcaaaagggtggtgatggaagaggtggctctcgtcgttgattcaccggagatggtggcttccttcatggaactattgtccattgataagttctcttggtggtgtttttttggttggaaagggcaacttctatcctttggcattttgatggaggaaatggttaatgaaaaagaagagcaatctcaaggataaggcagattattcatgttaatcctatagatctctacttaattactagtaataattagttgttgagtttaattataatgaatattattgttgtgtgtttgtgatctattttagtttatgatcatgtttgtgtactaggcctcttggcccaaataaaaaagagtatttgtgtttgtattataatgtttgagacttgtatgttatttcaaattattgatgaattttgattgtggtcctagcaaactaaaatgtgtaatttagtctttttgtgatatttaaattaattaggaccgaactatattattatcactctataattagttattaaatttgtgtatcatggtcaaaacgataaaaactaatgcacatataaattaactaaaagttcaatattcttaaccaaaaattacaaaaaaaaatcaatatttaagagattaatatgttaatttaatcttttctcacattgtattgaggtttgatgattatgtaaatgtattgtatatcataaaagtattctcctttagtttattcattcaaaaccctatgaaattccatgatcaaactgcaaattttctaagatagagaatatataaatattcctcgtttatttttagtagtcacttatttttaaaataaatttgttacttttgagatatcaagaaaagacaataatttttaaaaaaatatattttgccctcaacattaaataattgtttttcaaataatttttcaagacatttttaataggaaatatctaatcaaactgtgacaattaaaagtgaacgtaataccatactacctttttatttatctacatcaaggttagtgcacgtgatgtatttattttcttttagattcttgtcatttagcgattataaatttccacgctaatggtagttagtataaataattatacttatatttataaaattttcatcgctgagtagaatattaaaataagaagttggatttatctattttgtttttatttatgtcttaatataataatgattgtatttggaatagaggataataacttttcgtttttctcttattttgaaaaatatttttttaaaaaaataagattcttaaaaataaggatagtaataaattccttagtgaaaaaaaaaaacaatttttgggagtgacatttctgatttcaataataaattcctctctcatatattgtatttatataggaaaattttatgatactaactattgcttatgtaactaac

SEQ ID NO: 380 - DNA, 6871 bp, Solanum lycopersicum
catttgcattctaatggtggtgtaaaacggatttgttttaaatgtgagcttatttgaagtattttttttattaatattcaagtaatgtcttgttgaataacacatgcacattatatttattcaatagattttgtgaatagaaaacaagataaacaatatatagataacataaagtcatatcaattcaaattacgtgaacagaatgaacaagaaccaagtcttaccaataggatagatttcaagttaatcacaacatataatgtaaatgattacaagtcttgataatctagttgaatttaaaggcaactcaataatatgcattataaaacattacaagtatattttgataatctactataaacatttacaagacttaaatattcgacatatcttgtgaacaataatcttctcaattcaacaaaacttcaaggtaatacaataacgaattgatcgaatgagtagcaaagacaaacaaaaaagcactcaagaaaattttaccagttcgataaaacttattaataattcaacaacacatcaaccaaatgagcagtgtgaacaaaagttaaagagcacaactttaccgtgtcatttggttgtgaataagttatcccagaattagttatcccggattagctatcttgggataacttgttagctattttgggataacttatctcaccatgtacgtaaaataacttatatattattatgatatgagtggtggaataaattatctcaaatatgacaaacaaaaacaagttacacaattttatcctatcattatcttttatttttgtctcttacatcaaacgataactaaaattaaagatcaccccgaactaagaacaatttgtacaaaaacttgaaatcaagacaaggtgtagtgggtactgggcccaagcgaagctttgggcctaaaagttgctttactggcccatgaaaaaagcttacacagcacgcctggctcccatataatgttatttaacgtaataagtttgttatatatgaaatttttccaaaatataatatgaacccaattatataaacccgctcaaatttgaaatctccccaaatccccatttctgacaccattacagaggtgaagcaccgagctcgaactctctccagattctctctacaagaagatccatttccagctgatggagaggaaaactccaaatagaacaaggaggaagcagagaagcaaccaaaaaagcaagaagaggatgaacaagggttcactgtctaggcatttcactgttgggattgcaaaacctccgcttcctaatcaacaacagcttcattcctcactttctaatgttactttaccgaatccttctagattccagaaacttctggattctgatgaccttccgccagctcaatctcagttctcttcagttttgccgttgaatctcgatgctgatgatgatgccgatgttgccgatgttgctgaaaaggacttcattctcagtcaagatttcttctggtaaatcttttttccctttttttttcgattagaaggatatgggtttgaatggaataagatgtagagtagccactgagatttgaactggttccgattgtgccctttttttggtcccttgatgttccatatgagaccgggaactgattaaggtgtaataagttgattgcttactgttcaattttatattggttaggttttgttttttaacttttacccccaattcctgatcgtatcttggtattggtgaatcttagtagcttagttggttcactaacttaacttgcaccttgttggtaagggtttgattcccaacttgtaatctcctcccccgattttataaatataaaagatcatatattcacattgtatcctctagttttgttttctgcttataaataattttttggaatgcagtaccccggattatctaacgccagatgcacctgcaatttgtaatgggcttgatggtgataaggtaatttctttaccagagtgttaaaaattgtgactttttttctctatgacaggctgtagtttcagtatgtcatactgtgcgtttccctctatttcttttaggatgattatactccttgtcccaaatcacccgagaagcttctaagtgtatcaagaaagaggccgcgactaggtatgaaatatttcgtactttggtgtccattttacttcatttttcatttgtggaatcgttactggctctgtcaagtttttaacttttatcatgtaaattctcttctttcttttcttatatttgttctactattgaggcatgacaaaggcgtcgagtaaggtaaggggacaaactaatagcacattcggatattgaagaaaattagaacagaataatctctgaaagtttaagaaactatattgtgtatgaatatcccttgcattatcaagcttctatttttagccgttctttttgttactgttggacacctttgaatctggagatctctttctctctctctctccactttagcatgttttgaagtttgttgtttgcacaattatcttccataattaatcgtaaagttgtaaattaactttcttatgtggtcctttcgtgatgcccatctttacagcgtcggtaaggccttttagttccgatttatctggacagcagcagccagtagatattcctacagatacttttgggacagacgaaatgaaatcagaaaagataagcgagtcagaaaagggtcccagttatgtgtcacaatctgctattgctttaagatatcgagtcatgcctcctccgtgcattagaaacccttatctcggggatgcttccgagatagatgctgatccttttggtaacaggagatccaagtacccaggtactggtcagtgagtttgaataattggtggattctattttctttggaacaatttagtacttcaaaagaaaattagagtgtgatcttttgttcttcatggcagaattattgtgttgttttctgttaagttcctgatgttactctttctttgatctgtaggttttaaccctgcaatttctggtaatgatggtctgtcacggtatcgtactgatttccacgaaattgaggcatgttttgatgcgtgtattcttgactcctactaatactttcttaaatttttttctggacctatctaagacccttcattctttcagcaaatcggtagtgggaacttcagccgtgttttcaaagtctttaagagaattgatggatgtatgtatgcagtgaaacatagcactaaacagttacatcaagacacagataggtgatatttcctttctttcaacactctggcctttatggtatgacactacagagtgtgcatatttttcttgacatatcatataactaaaagaaacatttccttagttattttctgatatcctgttggccatataattggtagcatctaatatcagtggaagtttggggtgaggctttagtggtattgctatggggtttgcatgatatacgaattaagaatgcaataggaaatgttctacatctataatttatgtgtactgtttcttacatttggcatactgtgttttctccaagtcaaacattttcaatagatttgagcacgtatttttggacaatgtcttcataaggtgaatcttatgtgatgccaagcatgctgtttatattcaatatagttcagtcctacttatgcatttaaattgtgttcttccaggagacaggctttgatggaagtgcaagcattggctgctttaggtagcatgctgatctacttctgttcctgatattattatttgaactaccccagagattattgttcaaacatgttttgttatttatacttacaggacctcatgagaacgtagttggttattattcatcttggtttgaaaatgaacacctttacatccaaatggagctctgtgaccacagcttatccaataaaaaatattgtaaactattttcggaggtagaagttttggaagcaatgtatcaggtgcggctcttgttggaatctttaagagctactttgtgtcatgtactgagtatgactgtcttataagtctgaaataaagttagaaggaagatatatatcttgcaaaccaattataattcatcgaccaaagagataatttcttactatatacataaccaatgagcatatcatcaatcatgaaacttcaactgctaaaataactgtgatttctatctgttatttagggaaaacaactgtagcaaagtcagaacctaatccaccctcctaatacttgaaacatggagcacacaagatgcaacacttcataatgttttaaggttttcatggaaatacaatattcagatctagttccattttgttatttacattggtaggttgtacttttgtaacttgattctcattcaaatgcatataatattacccaaaaatcctgcattgagttggtgcttgttgctttcacacgagaaaagaggatcagactataggctgtataaaaaaagaaaaagagaggatcagttttatatctgttatagaagctgataccattgactgtatatgtgatccaaataaccctctttgaggtggtaggggagctgttttatatcatgtatcttaggatttattactatcctctagcttgagatatgactggaactggctttcaattttgagaggccgaagacctgtatagtaaactattttgagcttttagtcgtgatcttcttcaaaatgcttaagagttcaccctctactaacttcatttgcttttgacttccctttgcttgtttttgttcgtgtatctgggtattttatttgtggggtgggaaggctgaggaaacatggttgttcaaattgaggtcaaaatattgatacttgagatgctttctgatatgcaggtagccaacgcattgcagtttatacatcagagaggggtcgctcatttagatgtaaagccagataatatttatgtgaaaaatggtgtatataagcttggtgattttggatgtgcaactcttcttgataagagccagccaattgaagagggtgatgcacgttatatgccccaagaaatacttaatgagaactatgatcatcttgacaaagttgacatattctccttgggcgctgcaatatatgaacttattagagggtcttcactgccagaatcagggcctcattttctaaacctcagggaggggaaattgcctcttcttccgggtcactccttgcaatttcagaatctactcaaggtattaacttcttcccttttactatgttaaaaagtctctggatttgtattttcctttatgcttcatgttcatatgccttgatcatctatcatcttgtacaaccagcacgctatctgaagcacaatattccatatattttaatccgagtatatctaaactgtagttagatgatatatttcgtttgtctgtggctatgtatgataacgctaatccatagtcatctgtagaggcaaatgctaattctctatgtccaaattgtaaatgttctcaggcaatgatggacccagatccaacacgtcgtccttctgcaaaaggcgttgtggataatccaatctttgaaagatggcaaagaaattccaacaagtagatatccatgtaaatcactgttttctgggatttgtcgattgctacttttgccaaagatccagaattcaaagctgcagtatctcatgcagcattctggtgttgacctatagccatttctgtaaatagagataaagcttcatgcaccaaattttcccattttgatggtgccacttttgccaaatattatatcaagaatgtaatgttgtatcctaattgacctgcaaactgtggtttgtatgtcaaaatatggtatttggtggcttttaagctgattaattcagtattggtttttggttttggtaactcagatttgtattaatcaccagtaaaataattacataaacatggcaagtttagactcacttgctatttctcaagatggaaaatactacaaaactcaacaggaaattacggtttcccatttaaaatcgctgtgaaactcattaatttatctcatatttatcttaaaattatctaatacatttgtttatataatcatattatttatttttaggcatgtgattttatacagcgacatcaaatcataaaatgaaatcggacatgcaatttcatatcacatgaatttttcaaaaatcatgattttgagattatttaattacatttgagtttgtttgacattgatgttaaaaaacatttttagaagcactttttaaaaatgcctttttagaaaagtgctttagaaaaaaagcaatttgtttggcttattcatttgaaaaatgagcaaattgtgtatgattaaatatctttttttcagaaatgcttttaatagtcaaattaccaaaaaaaaaaaaaaaaggacaactattgatgtacttctagtattaaaattatttgatagagaaactattttaaatatagaaacttatagtcacttcaaaataattaattactctccatagctataatttgataattacaatttgaaattgctacatgttacagaagagagaagcgagcgagattgggagagagaggagagaagtgagagaaagggggaaaagagtaggagaaaggtgaattgtataagtatattgattagataattgtatattataaatatatttttgtatatggaaagagatattgagagagggaggagaaggcgagcgagactaggagagggaggagagagggcaaagggtgggagagaggtgaattgtatatgtatataattgtgtacatatgcatttgtatatatggcaagcgagaataggagagggaggagagagatgagcgagattgagagagggaggag

SEQ ID NO: 381 - DNA, 3421 bp, Solanum lycopersicum
ttataaagttgaactactgctctctctttttttgacataacgaacgattatttcaagaggtacctgcaaccttccatcgtaggaatatattgtatgatttggtggctcttgtataggatttctttcggggcagtacgtaccgatgtgtaaatgaaggatggggaagttcatttaatttcttagaagatgtgtggatatacaattgttttttttttattgaaaaaaaaaaattagagaagaaatgaaacattaaaaatagggaaataatataatattttgtattgttgaagaagttcactaatgatcttttggatatttacaagttcttcaactagcagaaaactctgacattaatgctacttgtgagaatgtggctttaataattgcctaccaatagcagctgcatttatatgcaaatgaccacacatcatttgcaaattagtaaactttttgaatctttttctctctattttatttttatatacaattaccactcatattttacaacatttaccctattaaccattttgtaagtgctaactagataaagtacaaaagaatataaaaaatttattcccctaaatgaaagtctaaaaatcacaaaatgaacatattatacattcattcattcatttaacaagaagctatatatctaattactgtcctctcataaagcacacttttttctttcccatatatatatatatgtatatatctccaaaaaaaactttataataatcataacatatagtattatcatttgccttttcatccaagcaaactccatcttttttatctagtccctcttttgtcccatactttttatttcctttttaccctttgctctgtcaatttcagtccttctctcccagatatccctcttgattttcttctatttatcatcctcctacatgtaccctaccccaccccaccccaacacttacaaaaaaaatttctttataattctcttcataagtcagtgtgtttttttagttttacatacatacatacatttgtagagttgttgttgttttatgatggaacatcaacacaacatagaagatggtggtaaaaatagtaacaacagtttcctgtgcaggcaaagtagtagccgttggacgccaacgagcgatcagataagaatattgaaggatctctactacaacaatggagttaggtctccaactgctgaacagattcagaggatatctgctaagttgagacagtacggtaagattgaaggcaaaaatgtgttttattggtttcagaaccataaagctcgtgaaagacaaaagaagaggctcattgctgctgcctctgccactgataataataatatctcttccatgcaaatgattccacatctttggagatctcctgatgatcaccacaagtacaacactactactactaatccaggtaattctttctactttttagtattgtcttggttaaaataaagcggactacctgctgctataacatgttaaaatacattaatagtttacgattatatatatacaggtgttcagtgtccatcaccatcttcacatggggtattaccagtggtacagactggaaactatggttatggaactttggctatggagaagagctttagggtaagttttggcctaataaaacaacaccaatcttagagttaaatactctatgttgcttgtgtttttttttccaactaagtacacatgaaatgaagaagaaaaaaaaagaagaggatatatatatatagtcctattatcaaaacaacattttcttcaccataaaaatatgagaacaactactcaacttgtcatatgtcaaattttcctttattctatacatatagtatataagatttgaactagaaaaaaaagaaaataagatttttgaaattgaaccctaattttgcaattgttgttgatgaatggttgaaacaggagtgttcaatatcaccaccaggtggtagttatcatcaaaatttgacatgggttggtgttgatccttacaacaatatgagtactacttctccagcaacttacccttttcttgaaaaaagcaacaacaaacactatgaagaaaccctagatgaagagcaagaagaagaaaattaccaaaggggtaactctgctttagaaactctgtcacttttccccatgcatgaagagaacatcatctcaaatttctgcatcaaacatcatgaatcttctggaggatggtaccattctgataataacaatttggctgctcttgaacttactctcaactctttcccctaaattatgaactagtctatcttatgtttgtagtaagtaagtactaatctaatttggtatgtgccaagctatttggaccttatggtaatgttaattaatcttaatctaagttgtactaatattattaattaaagtatggataagtttattagtctttctgtctcattttatatgatattttttattcctaatcaaatcgtatcacgtgaaattttaatttactatgaatggaggaattttatttttgataggcactagtcagtaatcactagcagacagtacgaagcaaatattgtactgttcgtacctacacctatggtaatataaaaccaacatgccatggagtttctaagccaaaacattaattgagattatgaattcaagatgattaataatggaagaatttaacattgtgctctcataatattttttttttaagaaaaaaaaagtcacatcaataacaaaaaggttatatgactaggggcggagcttgagatcagtaactattaaaattcattcgctttttcatgtatttactttttatattttaaattttcttaatgaaaatttacacttttttttacctcatttacaacatcatgtaattgtatacgttaatacttaatatggtaacctagaaaataaagttaaaagctatcataacataatagtttagaaattatttgtaccgttagggtatgaatgttaattttgtcgggtcagtgagagaaatgtttgagaatatatgtatcctaattcctaggtacttacttactaataattaccctaattacgggtagtttcaacactaattaataattaataaaaccaataattgtgtacatgattttaaggaggaagagtagaataggacagaatgaatctaaagttgaagaataattttaatgatagaggataattaaatcattcaatatattatcataaaaagaatatagataatatagtattggttaccacttgccacatataacatgcaactattagaattgtctttattgctcttagaattttggtcaacaaagtgtctatatcattgaatttaattatcatctcatgcgtgccttgaacatttctgttttacatctctttcacgtggaataacagatatattgtggtattcctttctg

SEQ ID NO: 382 - DNA, 5340 bp, Solanum lycopersicum
agcaacttaagtttgatagaagcttttcttgtatttttttttttggttaattactatcctaaagttttgtaatattgaaatgtttgcattactcatctctcatctatcctagcctcactgaacaaatttacatgatacatgttgctcccgcggtgatagatatcctttagaattagttgagatttgcgaaaactgaacttgtgcgaaatgttcgcattattctcttctcatctctcatcagtcctagcctcgctgaataaatttacatgacatatgttgctagtgctggaggtgatagatatactttaaaattagttgaaatttgagaaaactgaacttgttcgaaatgtttgcattgttctgttctcatctctcatctattatagcttcgcagagtttacctaatagttattacaccactctatgtgaaatgtttgctttattttcttctcatctctcatttgtcatagtctcggtaaacagagttatctgatacctgttattaatgagaggtgatagaaatcctttaaaattaattgagatgtgtgaaaactgaccgaaacaccaacattataaatataaaatatttataacacatgaaatctcatttaaatatttatttgaatttctttcttattataaaaatcacttttttacttataaataaaagaagttcaaactatatgattagccttacataattaaccaagaaactaaaaatttgtaattacattatgacaaacaaacaaattaatataactgttcatgtgacattattggtatcaaacttcttaattgctaattttgaaaaataaagcttccatattctgaactagattaaaattaaaatccacgtaaattaattatttgattctcacgatacctaatttaggtatttacaacattagtacttctacaatttaagtattacactatggtccaaacagttcttataaataccatttttcttaattaagtaaaaaaaaagtgctccacagtccacagagcagcaaaaatggcagcagctgaaatggagagaacgatgtcgtttgatgcagctgagaagttgaaggccgccgatggaggaggaggagaggtagacgatgaacttgaagaaggtgaaattgttgaagaatcaaatgatacggcatcgtatttagggaaagaaatcacagtgaagcatccattggagcattcatggactttttggtttgataaccctaccactaaatctcgacaaactgcttggggaagctcacttcgaaatgtctacactttctccactgttgaagatttttgggggtaagtttttttttttcctctttcaaattggtgatagtgtagtgtaagggaaaacagggagtggattgcaaggtggggaatcgaatcctcgagaaagtttagatagtcaattaattgagctactgagattcctcggattttttaaaaaaaataaattggggatagaggaagaggaaatgggggagacttttataaggttataccgttgttaacaaggtgaaattttaggtagttaatcaattgagctactaagattctttagatacgattttcgtaagctcaaattggaaaataaaaaattagattattactaaggagctgaagaaattcagaaatgagttaccttttgagccagcagaaccagttaagttgagatttcattgattttagcttgtttttaatgttggttgtgaattatggggttttattataatgttccaacaattttgttggtgttgtaggacttttttgatttagcgttttgaatgtgttctgattatctgccttcacataggtgatattgaggtaaaaatggcatcttgattgattttgctctcataattgttagattttcttcttgtacattttgcagtttttagttaacttgccaaggtgtttagtggatgcacaatatgcggtattactacggaatgtctgaattggtttgagctttagtttacccaagctgtattagtaattgcacattgctttgtccttttttagttagtactttccttaaaactggaattttgatctcttggttacttgccaatttaaattttagttcatggatcggattcaatgaatagatatatgctctttggtggtgggaggacaaggatagataaattaaactcggtaaggagagaaagtgcagaatgaatggaagttgagacattttggagtatggggtgaagaatgacctgtgaagttttaggaaagaaaaagttaaccttgttgaatagtcatatttctcttccttgcacaatcttgtgtaggaatgcctttaattgggtttatatcgtcggatagtttatattgcttcaaatctaagaaactctttcatatttgtcaaatgctcctattttcaacaaaggatattttgagctgaaaaggtagttgaataatgcattggtcgtagttttctctcctaagcaagataatatagttactattttcaagtacaactacttctttttctttagtttacgtataagagcaggtcctgtatctacatagctgtgatatctctatgtgcatttgtcttaatatactattcacttgtcttaatatattattcactttcaaaaataaagacagatgtgtttctatttcttaattaggctaaagtatgctcatctcctctgtagattgatgagacttagctgcaggccagttttttcaatctcacgcatagacttttttattaagtcctatgatttgagtaatgtaggtggtaatggtgtgaatttgatgtctgccatggatgcatgcaccttgtttggtgagttctttattggtctaattactcaaggcacttgagttattgtacaacttgaacgatgacatacctgtttgatattccacatcatggattaggtctttgaaatgctattatccttttggctcatgatgaaatcttgaaccatgttgcttattctacaaacagtgcttacaataatatccatcacccaagcaagttaattatgggagcagactttcattgttttaagcacaaaattgagccaaagtgggaagatcctgtatgtgccaatggagggacgtggaaaatgagtttttcgaagggtaaatctgataccagctggctgtatacggtattccgaagttatttccatccagcccttaatgataggtcattctagtaatgttattttcccctttgatataatttccactcttgttttcttatatggaattattgtagctgctggcaatgattggacatcaattcgatcatggagatgaaatttgtggagcagttgttagtgtccgggctaagggagaaaaaatagctttgtggaccaagaatgctgcaaatgaaacagctcaggtaatttgctttatatttttggtgtcaacggccacgtttgtcattttcttggatcaagcggacagacattttttgttgtgtacatactgtagtgctgatgtttattcaaaatatactatgaaatacattgtaccgttgagtatattggaagttaagaggggaagtcatcagatatataggaagtgctccttgtgagaaatttctctagtagggctcaaacccgagaaccatggttaaggacggagggatccctttggtggtatcaagggttaattatattatttcatgtttcatatgattgaaacatttggatatccttgcaaagtgtgatattgttttgtctcgtcatttgttttatgcttcataagaattatcttttctttcgtccccttctctttgtttctttttctccagtgtacttcattcttctagaattatatagtggtcggcgttcccttttgtgcttcattgataatattgaatcctttcagctgtttaccggttgattatttttatgttggtgcttattgctagttttttgtttttatatctttgcaactatacctaccatcttcctgaaacttctctttacaggttagcattggtaagcaatggaagcagtttctagattacagtgattcggttggcttcatatttcacgtatgaaatcttggttatcatacgcctttaattcagtttctcttcaattagcaagactcataaagaatcatcttcttttgcaggacgatgcaaagaggctcgacagaaatgccaagaatcgttacaccgtatagttcttgatgcagtgtgggattgcaagaaacacaattcgtactggaaaggttggtaggtactagtttagtttctcatttgataagcttctggtttgagtaactcgtgtgttggtgtttacactttctaatcgtggaaaattgtttgatttgaatccatgcctctatgtttcgtgtgttctgtgttactttcccagcttccctattatttctctgcagtaaaaatctctgaaaatattgttgatggaggtgaaagtgataccaagcacataacaaaacacaaatggaaaattataccaaccaaaagaatgacaacagtaaaaacaatttttggacgacttttcgatgtgaaaaggataagccaagcctggtgtttataccaaatctatgatacaagacatatgtctcgtatgcaaactatatttagtttggtgtaaacattggatgcgagccagtgtttttcgctcggtcataattttttcatgcattggactccaagagaggtcttgttggctcctcattaggtctgctgtatctccagtataagactagctgtatgatcccaagaactcctcctatcccgtttggaatctgattcatagagatcaaaatattaaattctatacacaagggtgtgatgtaggttgtctacctagttgtaagcaacccgtaacatataagatcacacgaaaacaactttactgttactctgagactctcccttctgtatctttcgggtactattgaaaaggggaacaacaaaggaaatccagttacttacgtagataaatggatcttgcttaaacattccataagcaaagaaagaaaggctcattagaaaagttgcaagggatagatagaacggcatatactcaacacttcttgttctgatcaccaaattctacaaaagtaaagaatttctctgttagtctcatcgagctagtgatatcgatgaaaaatacttaaatcacgcgttgttattgttgatcgacttacaatgatgaacaacggagaagcaaacatggagatgagagagataacagacaagtatccaacgaaagtttgtcgatttggaggttgaaatagacagatgctgatagaaaccacagcagcaaatgcagcaaacacaccaaacaacagccccaacatcttcaactgcattgaacatgtaattgt

SEQ ID NO: 383 - DNA, 11127 bp, Solanum lycopersicum
  modified_base (7662)..(8588): a, c, t, g, unknown or other
tgattgacttgattttgattttcatagtaaatttaaaattataaaaaggttagccatctactctctactttatgcccgtctcggtccttcacttttatctcttttatttttttaaaatttggatcttgtccatcattttaatttttttatgacaaacaataaaggaaaaaggaggaaaaaaacaattcactcatatagaaataataagttcaataaaatatgacttaattaaacaaatatgtacacatattacatttttcttttgtgtgtacccaaattaaaaatacaagaataaaaataatcatctctcttatccccaccctcatcccatcatgataataatacgaattaaaagaatataaatatattaagttcatttcaagtttgagtcctggatatcctaattaagaataagagattacaaaaaggaaaaaagaaaaaatgaacaagacatttggagaattgagagaaaattttgtattaacaaaaataataattcttttaaatggacaatccgttgggggtaagtatggattttagttggatccccatttatgagtagagttagtttataataaattgaggttgatttaaaacaggataatagaaagatatcatgaaattaattattttttcaatattattttcaagtgtatcgggtcaaaatatgaatcataagtggattttatagaaaaacaaatttttttaaacatattatttttgttatttatttgagaaggatttaaatttggaccaatcacattaaataatataataaataaatattaaataattttacttatagggagctattaaaaataataacatcgagtgacttttgagacgaaaggtgaacatcgggggatctttttttttgtatcaattcaaatagttaaaggacattttaaacccttctccgttttgacatatttatgtatcttttttttttaatctttttatagaaagcctatttgtagcccaacccaaaaggtaaaagattagcggttctagggtgaaaactgtcaacaaacaaatcggagttctccctcaatataatttgaggagttcaactgaaatcaccataaccaaacccacaaatttgcgggacgaaaacaccaaaaatggctgatgaactaaacaaagctgctttagaggaatacaagtcgtcatctgtagaagacagaggtgaggaaggagagatcgtaggggaatcggatgataccgcttcgtctttagggaaacaaatcactatgaaacatccactagaacattcctggacattttggttcgataacccttcagggaaatcgaaacaagctgcttggggtagttctattcgccccatttacaccttctccactgctgaagatttttggaggtaccattaacttttctttttttggtaggattagggtttctaatgttttgatcatctgtctttgatttgtaattttttttaatggtggtcggatatttgttgtgtaattattagatcttcgtgatttaaaggatgacttgaagaaatttagaattttacatgcttgcatgtagcagaaatctctagtacttactcaaagtagtattctttcgttttctaatttgaagttgtcaaattctctgttaagaggtgaatggaaaataatgacacatgcatcagaaaaattcacttccattcatccatgcatgacatgctttttgttgcttcatctttaattatagctaattaatatgtagactcatgagtaacgtgcttctttgagtatattaacttgttgtgatgtatacgttctttagtactgcgcgtttgaaggaattcaaaagccctgaactagatcattgtgttgaaacgtgaagattaaaacacgaaaataaggagaaatataggtgtactcaaatttacatccttttcccttttgatctctcaatgagatggaaaaataaaaaaaaacgagtaatatagttgtgaccatcgatttggggatggatgggtggaatagatcaagtcgagggaacttttgatgaagatcatatactcaactgaagtcacgagatcgcgatgatgcgccagatatgaacatgtcatattccaatatggagtcagaattaggtcctgcattgaggcacaaagttccctgaacaaagtgggaggtgtggtcttactttgagattagtggttattgtgtgagacgatatgatcttactttgagactatgttgcttggacatgggtctgggtatccaatatgggtgctgatcaagaggttggactcttctacacacaaattgtagaattttggggtatggatctgagtgcaaatttgtggatatgggtgcagggatatggacaataaaatatatatgtcgacatataaactatatattttgatatgttaaatccattgaactagaacttataaaactttattctaaatgaacaccaatagtttattcataagatatctcgcgtgatagaaaatcattttaatactttatataactatatatatatgacataaactcaaaaatcaaaaatcaaatacccaatcaatctatacatcttgttcaatgtagtcaaagtacccatgataagttgaccaaatcaagtattgatccacacccacactcatgttgtattgatagtgttgacaaaggttcaacatgaattttcaagagtccacgaaacatagctttgagatcccagaattcttagaagattcattttatggaagttgtattgggtctgcagtagacttctatttcataaattaattgggctgtactgtacactgccttctttgtatttttgttgtgtttactattatggtctcctttttcctttattttttatttctgtgtcatcaaaatattttgataactaaactttctcaaaatgatattttgataaataatggtaattttattgacgaaataacaaaaacagatggtaattttactgaataacactccactgtgaagctggtactgaaccagtacaagagaaagctgttagaatccttttatagcttttttggggtcatcaagaccacttgtggaagtctatttttattatttagtttgaagtcaattttttattatttagtttgaagtcgatcttttactgaacattaccaaaaacctactttctcaagacatgccacagaacacacaaaagccaatgtattgatgatggctgctgcaacccataaacctactgccttgtaatacttatattttttttttttgataaagtaacattgtaatatttataatatactctctctattttaatctacttctcttacttttcttttagtttgcttaaaagagaatgcttctttttatatttggtaaccctttattccgacatttctgacatgtttatggacacaaaatttaaagagcattttggtgcgttacacaacttcaatttaagaccacaagattcaggtctcccttatttttttaaagaacgtgtctagtcaaactaagacactcacattgaaacggagggagtaataatgttgcttctaaaacttactccttaaatctcatctttttttcactttaaattctgatattttgtattgattatcctatgaaaatgtatagattgttggaaatttgtttttctcctcagcaaccatacggtggaaagtattttctactcactaactaaaacagaaaataagaccacatattttctaagaaaacatgtgctggtggtgccggcaatatgttttccacgtttttctcaagagtagagatgctcagagttatttggtacttgtgctggtgggatgtagcagatacctcgtggaattagttgaggtgcgggcaagctggcccaattataaaaagaaatataggatcttactttattttatattctgagatcatggattggatatttgatttattcctgttgaatattctgcagtgtgtacaacaacatccaccacccaagcaagttggccgtgggtgcagatttccattgttttaaaaataaaatcgagccaaagtgggaggatcctgtatgtgccaatggagggaaatggacaatgaacttttctaggggtaaatctgatacctgctggctgtatacggtatgcccatgatgttcctatctgattcttagtcttgtgcctaaactggctcttttctttcccatatggatgaagttcatccttaaattttctgatatggaatttactgtagcttctggcactgattggagagcaattcgattatggagatgaaatttgtggagcggttatcaatgttcgagttagacaagaaaaaatagctctgtggaccaggaatgctgccaatgaaacagctcaggtaatttctttaagcccaaaaaagacataatataagtacttattactacctgatttttggctttgaacaagcagcttcattactttgtgggactaagttgagaaacagaaaaatgtagtgtctaattttgtcgtgatttgcttaaatgtcatgtatcccatttagtgatgccatttaatagtaatgacagtagacaacagtagaatcaccagtagatatgcttgagaaagagaacgtcagtcacaattgtttttttcaagtaatgacattggtgatgggttggatgttgaattccaattctaggaactttctaagtggttttaaatagtagtgtattatcatcaatgggtgaaccaaggggaagattgtcacaaaggggcatatcgactttgcagtcaaatccttgcaactttttaatttgttttaacaagtgtatctacatttagatgcatcacatgaacagaaaataatggcttcaagagtgtctgtttactagtgaaatagcatgcccttacatgtgctgttttaggtcttcaacgagcacttatatatgaagttttaggttttctatatatattatgctgcatgaattctcttcagtattttgttaaatatatgtgcaaagaggtagtttagtgctgaatgctccaggcatcatgtgttcatattctgtatttaatcaggacggtaagtaaagactaatttttgtcggtattattttaattcccttaaatagcctgttaccacaatcagaaactgatacatatttcctagcaaagatgtattgtcttattcccatatcacaatatatatatatatatatttatttatttatttttttctcatgcaatcaaggtttaaccttgtggtcaatgctgaaatgtaccatgagaaactagtttcaaatccctgctggggcaaaaggtgttaggtgatttcttttcatgtgtcttaagccttgatggtcctgtgctgtttagaactagcaaatgcctggtgggtttgtcaaaatgcacacaaagttgccttaatagtttcaccactttggttttatattttagtccacaatatcgtatagctcaaacgtcattaccttgtgtatttatatactttatttttgtcacgacccgaaaacagacgtgatgacttgtctacttccaccaagacaagtcaacctcaacctaacaaaacaaaaaaaatgcggaaatacagtaaagcaagacaagatgaagtggaaaactgattcattccctattaaaaccctcaaaatttggttatcgtgtatacactctactaaatacatgaagtgaaataattacaagtctcagccttttgtttctcaaatagaacaaagataaagaaaaaggaaaaagaagggccactcttcaaatccttgacaagcctcggaaagtaaaagaaggactatcacgttataccgggctaggaatctacaaaagtgtagaagcaaggagtgagtaccaacaaaatagtacccaacaagcaaccttataaacaaggcatttagctagaaatcgaatacccattacactcagaccgaacttctcctaaaactacaacctgtatagaaatcaacccaacctagcaattctataatgcacaactcataaggctcaataatcacagttcatagtcacaatttaacaaccaaacaaatcaagtcaatctcaatatcaagtagatcaatcacacgcaatcaaacacaattaacaaggaactcatacataaacaccaaatgcctcaggtcaccataatcaatctctcgccaaaaccatttttcatcggcacaatatcactagtcagaaccatttcccatcaactttatatcaatcctctagccgaaaatgacctggacatcacaatatcactcgccgacaatgacctcaacatcataaacatcacatgtctcatcatggttttccacaatcaatgcacacaagcactattactccacatggaagagataataactcatacaattcaagtccatattaatgctatcaagcatttcatcaatcaatcaacaatgctcacaataaggcaattcacatcatcatgttcatcacatagcccttcatttcaacccctttttattcatttagatatatcaagtggacaattaaacccttcacccaatcccaattactcccaacacacaagcaacaaaggaagtacacgaattatactagcatactgcatacaaggtttaggagatcacttgccttaaatcacacaattaaccactgaacgagttgagtcttaaactttcgcatcacctccaaagccacacaatctataacaatcaagtattcacaatgaatcttcggaaacaacaataagatttgaatccaaaatttagtacttgaatacattactcaaggaaaatgaaggtttaagattataaaagcttggcattttatttaggaacttgagttcttgaaaaacttgccatttactaattaaattcccaaaatttgatgttagaattcataaataaccaaagaaaaatgaaggtttaggatcataaaagcttaaattgatttagcataagaaatcctttcaaaaatgccaccaagggttccccaagctcaaaaatttaaaaatggggctttaaacctgaaaatggcaggcaaaaaccctctcaggtatcggttttgtgaactaggttgggcttaagcaaacctcgcaaaagttgggggtctcgtttttgcgaactaggttccgcttatgcgaccatcgctaaagaaaactatgcccgaaaggccagtctgtttttttgaataggtttcacgtaagcgaccatcgctaaacaaaccaggttccgcttaagcaaagattgtagcaccagaaacatcatatcgaaaggatcctcgagattcgttcgcaacccgttgtacacaaaccacatatgctaatgaactatgcttgacatttcagactcaatagaatcgtcaaaatacgaatttgaggtctccttgactcgacatctgtgaaaatcataagaaactaacttaatgttcaaaagtgtaaaacaagctcgaaacctctcaaaaatcatcccccaaattcaacaaaacactcggaaattctgagccgagcatccaaaccccgaatgttcaccaaagtcaacccaaaagcccacaatttcacaacttaggacctcaaatcctcaaaaagactcagaatacgaaacgaacaactctcacaactcagattccacattccggtactgatggtattgatggaactttattccgacactcgaagctcccaaaggctccaaaaaccacttttgagcaacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttttatgttttttcccttaatatttttatacaatatccaaattatccatataaccctaacatctctttcttctatttttcccttttcacgtttggcataacaacttcagcacttttatccatacgcataactgcttattttaaaaataagtttcagcactttcaaaagtacttttttaaagctgcttttattaagcccatccaaacgggcccttagcctttctaaagcaaaaacttacgaaattctcaactctttaactctatatttaaaattaactttttcaaattcaatcataagagactcgaggttgatatcgggagggcaaaaatggtaaattgtcgaaactttcaaaaaatgaccgaccgggtcattacaattttattatgggtagaatactttttgaaatttgcattatacggattcatcatggcataacaagttttgtgttggttgttaatctactacagtcttcatctgggtttgggatggtgatgtgaacaaatatcataccaccaaagttactttgtaggagtaagacagaatacatattctgcaagtttagccagctagataggtctgaagttgaggtgacattagaatggattgaggtacctaaatatttgacaattcagatgtttaggcacattgtttcaggagaatggaatgatggatgaaaatgtcaagcataggaatattcaagtaagatggttgaaaaggagtgccacataaatgttatgtgacagtagtaagagacctaccaaatgtaataagaagtatattggccccaaattgatagagtactaattcactttgtggttgaattcacccagtccatctatacagtagctatatatctttgactacttctgagataatgcatgttttgtgttgccacttggttattcttaaccaaaacatttttttttcatgtttccaaccccccattcctatttctggtctgttcctaccttttcttctagagttacacgatctagcattccccattccccctttcgctgtctactagccccacccacttgcatctaaatgaacatttcattgcaggtgagcattggtaaacaatggaaagagtttttggattacaatgacacaattggctttatatttcatgtaagatgtcttggttatataattcctggatatcatatacttgattaatttgctcaactcatcaagaaccatttgtttgcaggatgatgcaaagaagcttgacagagctgccaagaatcgttattccgtgtagttctatcgttacaacagggaatgcaatcaatagagttacaggtagtatagttgttttactgaagaatcagcagtcacttacggctgcatgttttaccttttgtattggcattgccaattttcgtatagggtatttgtttggttttgaagctttttgatgacttaacgattggccatatgcatacttgtattagtaccgatgttatagaggtattttgctatttctgtgaagttgacagcacttagcattcgtatgtatgtgtttcgctttcctttgcaatccaacttactctttgaggggtcatttgatatggtggatgagaataatactgagcatgggcttcattagtaatgtttgcattagtaatgctatatggtttttgatggtgctttatacttgtatgaatttgtattttgaacccatttacttgactatttgccaattgaacccttaaactgaatgaaacccaacatttaaacccctttggctttgtatgaacttaaacccttcattgttatttgacctactcttgtaaaatccttttcagcattaatgccaatgaatcactattaatatttcagtttattttaatatttgtacacaattttatggaatatatttcatctaattttacaaggacattcagcaattacttttcacccttctagctattgaattattcaatatcagatggagcactaaaattgcaacaacaaaaaaagttctcattagacacacttcttctgctgttacgagtattgcaccaatttttttgtttttttctttgctcattatgttctcattttttgcacaattatgtttctaatttaaaggaaaagaaaacgaaaaagaagaaagagagagagaaattggaaaggagtggggatgggagaacgaaaaaatgggtgggcgaagaacagggaggtaatggtcgaaagaggaaaagaaatgggtaggggtgggtttgggggaaagaagaaagaagtgaaacttctaacttttttgttctttttattctattttttacttttaattgtttttagtcttaagttttatttctaggttcctttgtttttttaacgtgaaatcacgtattagtgtcaactcaacaattaagttgcaacataagtttggtcaacgcggtcgaacaaatttaacatgttgagtttaagagttcagttgggattcatcataccatttcgcctattcgttatgcaaagattatttcttccagttttttattttgtgaattaatatttatgtaagaaaata

SEQ ID NO: 384 - DNA, 2979 bp, Solanum lycopersicum; identical to SEQ ID NO: 224

SEQ ID NO: 385 - DNA, 11127 bp, Solanum lycopersicum
gggtatcaaatgagcggatttggttaaattagaaatattaaaatgagttcaatagaaattgggttgggtcttgacccgcacaaatttatccgattaatctcaataatttaacatattgatatttaatttttataatcacaatttgaattttcgcttaagaattttttttgttaaaaaagtaacaaatggatagataaaccctaaaagatgttagataaataataattcatacattcatataggaacatatcttaataaaaaattttaaaacgggttgaaattagagattgaattgggctcaattaagaattctcttcaaataagttaagcttgaatgggttgagaatcaacccaatacaaatatcttgagtccaaaccttaaaattctggacggattagacgggttacctatgtttgagttcacttttaacacccctaaataaaagtgaacaaaaagaaaagaaaaggatattaagaatcttgaccataaaaataattcatacttttttttattcttgaaaattaatgtttgattataaaaatttcaaatttaactcgaaattatatttcaaatttggaaaataattataacatgttttcaacttaattttcgctttaaagttttattaaagtacattcaaatatgaacgctattacaaatattcttttgaaaaaagaaatcaattcgagcaaaccctattaattaagacattatatgtaaattattcctctcttcattaaaggtcttgaatttgaggtctgattataaaaagttcttactaaaaagtactatcatttaaataggactttatattacacaaatttaaaataattgaactttaatacgaatacccaaaaaagaatgaagataaggaaatgaagcactaatgttaacacgttgcgaaaaacaaaagaaaaaagatataaaaagttaaaaatgttatttgttttttggttagtcaaaagtttgaaccttgactcacactatggttaggtaacactattttctgtgtctgtctttcttttgtctctctataaaaacattgtttctttcagctttctccctttatttatctctcttttcatcagatcagtgtttcatcttccagatcctctggttagtacaatctttaagttaatttattatctttatatatataaaaatgtaatcttgctggttcttttttttttttttttaaatggttaatttacaaatgttttagggcttcttgtggttcagaatctaaaaatgttgattgtagtaaatagatgattgaattaattgttaaagtagagaaaaattggaagttggtagctatttttaagcttttacacatatatcttttatgtataaatgttaagtttttgcttttttaaatgtttttttctggggttagtttttaaaggttttaaggtttgaagtgtttcagaattgagaatgctagtgagtagggtgttgaattgactgtgttaactgtagttttatttatgttttcattttatttattttgttgttgttattattggagtgatgggtaatttgagaagaggctgtgtcatcttggatgaattaaagggggttttagttacttctttgttattttggaagtgattaattgtaatgtatggtataattttgaggttaacagtgataatccagcgaagtttatttacgagtattggaatgagatatatttgaatagagtgaaaggggtataaatgacagtcgaaatgaacacgtaccagtttaacaatgcgacaacatatccaatatatatattcctgcaagtggggtctgtcaagggtaggtgtacgcaaaccttgctcctacttttgctgggtaaagaagttgttttcgatagatgcttggctcaagaaatcattttcaaaaaagatttgaaagaaaatagatgattcgtgtagctgacccaaattatttgccatttaggcttagttgattaataatgaggattcaactgccttttgtttcttctctttgtgagtttccttgcaacaatgaaatcctgaacatagttcccaagtgatcgtgtgacatttccattgatacatttgtgtataattgccttagttgactctggggttggagaagggtatcttgaacttttattggattgagatgcaaacatgggacaagggagacgtacttcgattattctgtagatgcaattgaactgcagttgcagtatagtcttttgtgcataagtaccttattggcttatattttttctgttaattgtttctctttgaaaagtaggcatacatggacatcataaaggagctgtaacaacagatttgagatccctagtttaactatcacacaggcctatgctgtcggtggttttcgaaaacatgggctcgttgtgcagcagaaacaaacactacagtcaagccgatgatgaggaaaatactcaggtatgagttatacgaaatagatttggaatttggtatagtccatagtactgtctacaagctaggagagcgaaaaaaatatcttacataacccccagtgtcctgactagatcatgtgtcttcagactgcagagatagaaagacggattgaacaagaaacaaaggcagagaagcatattcagaaacttcttctacttggtaaataaggaaaaaaatatagtcttcaattatcatatgatctagtaatttcttactttgtctttgcctttgccttttccttttatggtcaccatacccatgtagtgatttatgatgcctacaagctataggcatattctatttctacattcagacttgttatatttgaggaggcaattggttatgaactttgcttttcctcgaaggttctgcttcataagatgctggtggaggaagcatagtgaaaaaaagattctttggaatattgttgtagcatagaggaacttccacctctggattgacttatttgtcgaattctttgttcttccttgtcttatagtattcttttgccatattttaaacttactgctgtgtgtttgctggttaatgtcctgtttgactgtgcttgctgaatgctgatttttctgttgtttcaaggtgccggagattcggggaagtctacgatttttaagcaggcaagagatcttataaaatatctattaagatttcattacttttaaaatgtatatgttaatgtgttgaagtgcgtgaccatcttatctaaatggttaagtttccacgcatctttattacttaattatgtcttcaacgtgtcgccacatgtgccggatggatctaatcaatgtccgtgaatgataaattataggttgaattgccgagcttgattctttttgatgagccaatcacgtgaactttttttttctgataatggatagtggtgagactcgaatccagtggcggaggcagggggtttagaatatgaagaagtaaacatgtgaaaattacaagaaaataaacgcagcgagcggcgaagggcaggacttagcttaacccactaaattttaatatgtcttgtcaataccccatttaacatttcttcttgcttttgcctttgctccgtcaagctcttcttagataaacttcttggctgtgtcaaatggatttattatggaatatatacacgcgtaaaaattaaattttatctgtatatacggcaaagggggttccacccctagctctgtccctgctcgaacccaagacttttgcctgctatgataacgtgttaaatgtatcatttcatcttaaagtttaagttgttagagagaaaatttttatttactttattatatgttctacaaaatgtgtttctcacatctccagtgtgctctattatgtctgccatgcagataaaactcttgttccaaactggctttgatgaagaagagctaaagaactacatccctgtcattcatgccaatgtttatcagacgataaaagtacgaaatacttgaaagggtgtgttggttattttcatttttgcaaaataggtgctgcttgttggagagacatgcatatatagaaatgtcatacacatgattgataatgagtgtcaattaccatgtgtcatggatactgacattcttacatggtgggtgcttggtttcaacagatattacatgatggatcaaaggaattagctcaaaatgaattagaggcctcaaagtatcttctatcagctgaaaataaggtttgtgttattcattcttatgcaattaccagatattttggctatcatcttgaagtcatttggccaagggaaacccatgaaagtgaaggaatgagattgctcgtcttacttagctgcatatacataaacatatatttctttggttccaggagatcggcgagaagctttcagaaattggaggcaggttggattatcctcacctgactaaggatctggtgcaggatattgaagctctttggaaagatcctgctattcaagtaattttcctttgggttaagcactttgattatttatttcagtttcaagtacttcctttgggctcgttgatttttataaacttcacaaaaatagtcttttactgttataaataaatgataattgaaatgatcaattcattgaaataaatcaatcaactatgcctcaatccttaactagtatttttacaaccccaaagtatttgggatctctcgacatggtccagtatatattcttctctcttgggagcatttcacgtctccttgtaatgccatttgttggtttgtctttaaggaaaaatcaggagttctgcaaaactagagactttaaagtcttactctttttcctaatcgatctaatgtgaagagccaaaaattactaaacctcattcctaactagttgaattttctataaggatcattttccatgttgttatagtcttacctaagttcaaatttatacctagatatcacagatcttttcaggaaacttgtctctgtgtgatttaggattcccttgttccattttagcaccttcattcaataaagtgtcgtaccttcagactggtgcatttggatgaacatggcttgataatctgaaccttctctcattttattgcgtatctatgttgctcgcacctttttcctgttggccttagtggacgataactgtgctagttggagataacaggtacctagtggaatagttgaggtgtgtgcgagctggtatcactgtcataaaaatatgtatgttacttgcaccttttgtcagaggttcttatcctaattttgtcttgacttgtatgactgcaaattgtatcttaactgtcacattttgaagacactcatattgggaataatttttgggctgtaaaggcccatcattcactcccacgctgccgtctttgctttcactatatttgatatcttcccattgcataacgatctcataatactccacatcagtcatctcttctaactctatatgctacatctttgtttatcctggcattcattctactgaaagaccgagcatagatatctgaactattcatatttagcaccacaatccatcactttaccttcatttttcttgtgtgtgctaaactggcaatgcatatagaccgtcttactttaacttgttcccaagcctctttctttagattgcttttccatagttctaattttaaatctcattgaagcaaatcactttagtatgtgattattcatacaatagctgatcagagattacccttcggggtggcccagtggtttgagcttgggacttccatgttggaggtctcaagttcgaaacctcttgccagccaaagcaaggggtttgccttctgggtcgagctcgtcgcacaaggcttgcctagtgcgggttacctctcctatgtggtttgcgagctattgcatatgaacccagactgtgttcagaatgaacgaaaatgtttaaatagaaaatattttctaggaaaataagtgggtttcttacttgtttccttgtgttcaatatgtaagcaaaaaatattatcctaaaagcatttatgaatatttctagtttatagaaaaaagaacttatgtatattctagactaatactatgggaggtagactaggggtgcggggtggtgggatagggctatgggcggtaagggtgtgaagatctggtgtgttggagggtggagacacaattaatgtggaatgcacctgttgaacttgcttttcctacttccactagggaagtcattttcctcatttttaaagaacttgttttcctattaaaaatgttctcaaaaaattatgaccaatcaaacattgaaaaattggaaaacatgtctccctccataacgaacacacccttaatcttttattgagtaaagattaacttgtcttttctctgattgagttctttctttcttgtaggaaactctgttacgtggtaatgagcttcaggttccagattgtgcccattatttcatggaaaacttggagagattttctgatgtacattatattccaacaaaggtaagaaatatcaattaggtatttcccgtttagaagttgtgctttcattgcaataataaaatctattcttattctcatattgaatttgcaaagaaatcataaccatctgttctccaattctatcacaaaactattttcgacacgatgttgaattcagaattatacatatcaattttggcttagatgcattattggaagtatttatgtttgagttttggtcttagggatgtcaatctgttgatataaactggaaagaatggtagtcttgacatgtataactttgacaggctggaccaaaccaattgtctttcttatctcatcttaacccacccatttgacaacgctggtgttggtaactattccaaaattcaaactgcagcctgttattgttgaaatttacttttagttatggctgtattttagtctaataagttgcttagatttaggatgatttgaattttatatttctattagggtttgtttagttgagatgtttagttgagacttgatatacagtcttaggttttctgaattttaaattagtcagattttgtgttttaagttggttatttaaagcccttatatgcttcacaaaatcattgagatgcattttaaatcaatactttcaacctttttgctgcaccatctttttgaagaaaaataacaattatagttagatacggtgtttaacatccaagatacttggtattacagtacgcttgcccttacttactgtatatgcttgtatataattttctattatattagtggtgttctttatataggaagtgtaagtgtaagaagtgcaagtgttgcttgtctattgctggtaaaggaaaatgtggttcatctatcaagttcttatagttgctgttcagttactctcaattgctataatttctttcttcatgcatagtatcttggattgcatcctgtgaattgtataaattttcttatctaaagacgggttactttcattttatctatttattgtactcttatactctcctttatgtgctggttaaatacttttcctagccaagcacaacaaaattctttgatgaaggaatcttgtctgttccattcatgttaaattgtctagactaccttatttaattgtaagatgttagagagaaaaaatgtatttttaatgatgtctttaacactgttaccatatatgcattaccgttggtttatttacttttttggagatcttaatagagtagtcatttttcttgttatcttgtaggaggatgttctttttgcccggattcgaacgacgggtgtcgttgaaatacagttcaggtgaattttcacgcatccttgaactgtcttcttatccattttctaaaacctcgctttttgtggttgtatacattatctcttaaaagaagtgttggcttaatctagagcctaaaaactactacattgtaccgaatttgcaagcaaagtgaaagaactgtctgaaccgctccttagttttctttgtcctgttggaacaacacatatgttggttgaaatccttcctgctatctcttttgtaggcaggtccaatctgccttgaagagcaggcttatatattctccttgtagcattcaatgaactacgtgatatgcttttctctgtgtaaagtcatagtcatgctgttgaaatattattaaactagttgatgtgcagttcctgtttagcctcatcttttgtctaagtgtctactttgcctgtcaaagtaggtacatttatatgtccttgcatttcttgattatgatccagttcttgtggtcctccaacgatgcaattgtttatgaccttatatttgttatcttacaagataattgtattctttctacttacgatggatatctttataactactaaaatatctgcagtccagttggagagaacaaaaaaagtggagaagtatataggctttttgatgttggaggtcagagaaatgagagaagaaagtggatacatttatttgaaggtgtaacagcagttatattttgtgccgctattagcgagtaagatttctgttcctagatttctgaatttcctaacatcatttacttttaagtcaaccctaatctggacttgatcacgagtagcagtacgtggatcacgtagctttccagaatgaggaaggaaataatcattaattactctaggtcaaaaggattttaaatttgtgagtaggaaatgatgcaactgcatacttatcattattctattattcacatcaggtatgatcaaactctatttgaggatgaaagaaagaaccgaatgatggagaccaaggaactctttgagtgggtcttgaaacaaccatgttttgaggtcagtttttcgtgtttgctggaggacaatgcttggttcaggatcttgaattatacaatatccacttgtatcagcttgtactcatggatcttttttgttacatgcatttgcatcacttcttttgggtttaaaaaaaagcaaataaatcagaccagttaggaagttgacactattctttgtgcagaaaacttccttcatgctgtttctcaacaaatttgatatatttgagcagaaggttccgaaagtaagtacattttatttagcagcggtgtctgtctgtgaaactgttctttctcatctaagaataatatcccgtggttgtaggtgcccctcaacgcttgtgagtggtttaaagattaccagtcagtttcaacaggaaaacaagagattgagcatgcttatgagtaaggttttttcatgtgcagtacttctataaatgagaacatattgatcccacagatgcatttctcgggctcttcaagaaatactaaaattttcctgatttgcttttcatcacataactagaaagaaatatatctctcaagtagcttgtacgcacagttaattcacataacttctctggaggacttcagtagtctatagctattacgattgacttgcatgttagaggggatagcatagaatcttttttttttttttttaaatttactatattggtctattttctgctttttgagtttatcattatgaaccaatattttggatcttggggatgtggccagaggtcagtctttccattgacattcttgtttaattcacgtgctaaatggtctattctggtgttttgatgtactctttaggtttgtaaagaaaaagtttgaggagtcatatttccaatgcactgcaccagatcgtgtggaccgtgtgtttaagatctatagaaccacagcccttgatcagaagcttgtaaagaagacattcaaactggtagacgagaccctgagaaggagaaatctcttcgaagcaggtttattatgaaattctttaaattttcaaaagaaaaaaacagaaatgttcatactgtgaaagatgcatacaagttttgaacagtgaggttcaaatacagaaaaaacaggctatggtggtgggggtatcatatcagattcaacaatttaagttttgtccatgttaggtcactaagcacatatttctttctttatcccggtattgttatgctctacttacaaaacagatggttcagaacaaaaactgatattcaagtatattctattgatgttcattttgttgaatgttgtaacattctcacagcgcaaagttgtacatgcattgttggttaaccttttgctatctcgtgctttattcagtttatcgtttagctcttacccagcttcagctattattgtgatgttatttcaaaagcctgttcaagatttcaactagtgttggtttacaaccctatggtgaatttttttccttcaactttaatggtctttgaatgttgcggttttaggttttagttaacttttgtggtctttgaaatacaagtagggctgtccataacccaaatacttgtatgtcgtcttagctaggctaggaaaatacacaaacattttggttttatttggtcatgaaattaatgtgaaagttaactttctaaatataggtttctttttgtcttcttatagcatttgtggttaaacttatatatacagattgttttataaaatcaggtcacctaaaagataataaatttatagtacgacattgacaatgaatataaaaataacacctcatacacatttaagattatatatatcgagttataaacatactttttcaaaagaaatcacttatagcaaattattatcgagttataacatatgattaaaaatatatttaattaaaaataaaattataagtaattatttaaatattaattaatatgtttaatttttattttttatttttacagttacctttttaaaactcttaatggtttacatttacctttttaaaaataaattaataaagtaatgttaatcacatagtacaattaccttttaccttttttaaaataagtaataaatttataataatagtacagttacctttttgaaatcaaaaaaatatattttagagatttgattttaattaactttctactttaccgttgcccaataattatccacctccattacaccccatacgcgaacaacattcttcttccccaacacgtctcactcatcatcttccccatcacgcgggatttatccctatcccatcaagcctcacagattaaattctttcccaaacccacaactcaaagatccacaacttctattccactaaa

SEQ ID NO: 386 - DNA, 5285 bp, Solanum lycopersicum
gaacaaatatgacaattgaaagtttcactaatactaaattaaaataatattagtgtattcaattgaaagtttcactaatactaaattataataatattagtgtattcagagtcttcaaatcatgagttcacccctttcttttctatatatgatccaaaaaaggccatataatcaccaaaaataaaacgataataggaagataatgttagagtggggtaaaaatttcacattggttaggaatgaactgatgatctccttatatttcttcataagctaacttttgagattaagttaagttcaagtatcataactttatctataaatatactaaaaaattatttttctaatcataaaaacaagaataatatttaccatatctttacatataaatatatctttctaattgtaaaaataagaataaaattgatatacattctatctctttttggacttttcacatgagtacgtatgtcattgttaatgtttttttagagagagataagaagaattgagaatgccctatgaaataaagaaaagaaaaaagtcattaagcgtgcaagcaaattggagtttgttaggtgagaaaggaaaaaaactcatccacttgtaaagttataatattgtcaaaattttaatcatacaaaaaaataaaaaaaaatagacactattttaagattagtttgaaaatcaagtacccaaaagataaaaaaagaaaactcaacttcaccaattgaagaatatgaatatgcaccacctaattaattgaattgcatcgaaattaaacacaaaacacttatctatcaattgttggtatctatcaatttatgtattatagaaaaactttgaataagaaattaaaatccatccttcacccactatttccttctagtgcatttcattattttaattttaattaaataaaaaaaaaaaagaggtcacctgtcactatgcgacaaaagcgcgtattttctaaacaatgggccctgccttattagacttcgttactcttcgaaaagtcttctaaatatttctagaacctcttactagattaaatttgcttttctcattcttttaatctctcatccattttcaaaaccttgaaggataagagagagaaaacaaatcaagtttttttagagcaagaaaagatagttatggtcgtgttgttgttggtgaagattggcaaagttgtagccaatggaagattctaagattatcatcaatcgtcctaaaaataatcttgttcattctctagtctttcttttcggtttctattgttgggattgggaatttcttactgcccttttgcttttcagttattgctccttctaattaatttcttttaaatttgtaaaattcttataggatcttgtcaattaataagtaaaatccccaaaaggggaaatttgggtagatttagagaaagaggggatgtcgcaaagaacagcgccggcgccgtttctgttgaagacgtatcagttggtggatgatgcgaccactgacgatgtcatatcttggaatgaaatcggcacaacctttgtggtgtggaaaactgctgaatttgcaaaggatttgcttcccaaatacttcaagcacaataatttctccagcttcgttcgacagcttaacacctatgtacgtctcttttatatcctttcgattgcatcgtttaaacaatttcaattgttagttactcacaaaatatgtgatgttttcaacttttaattttttttgacagacgtttttttaaatgttactttacgataattttgtatcaagtcaaactaaatcggtagaactttaatttaagctaaactaaattacaggggatggtaggtatgacatatttcctatggtatttttatcaagaataaagtaaaaaattatatttcatttttttttaagtaatatttaaaagatagtttctgatgctttcgggaaggttcgagaaatcttctccgcaggacgtgaagtcaattatcttattctgtaacacatcagataggttctttatttattttcccttcctctctctgaggaataaagaaatatattatgcaacctttcgaggacataaagagccatatctatcatgtgtctatactataattatttttaaaaaaaaattagtagtaaaaatgtacagtagtattttaactttattgaattgttagatgtgaacttttagaaacgaaatgatctgtattttgtaactttttatcaaccgaaccttacacgcggtggttggtgataaggaaagaggtagaaacagtgccgtgaattatcgtttggggattttacatgtcattttccaaataaggtgacaaaagtccaattggaaaacgtggattgtatgtgtgttccccataacaatgttctcctctagtgaccttgtcttactcgtagctggaattttagaatttaagagatttttaagtaatgattctttatataaagtagtaactttacaaattaaattcattctcaaatactttttttctaatttttttttctttaataaactgttaactcttttctaattttacttcggttttagattttcttttcccaaaacaaactattattcttatattctccaatatccagaggaaaaaaagaaaggtgaatcttcctaaaaacccaaaactatgaaagaaaaatgttgttggtcaattttagctgcataagttcgcttattaaagttacattcaaatttccccaagtaatttagtactctatttttttaaggccttttgataactatcttttacctagtccaatcctctagaagccaaaagaagatactaataattatggttttggagtgttaaaagtaaaaaattagaaaagagaatagagaagttactattggagttataccaaaaaagcttttgttacggtttcccttgatagcgaaaacaatgattaatggacttttacccattgttaaatggagtgaagatgcagattgttaaccatgatcttattatgttattgtatatttatacacatggcatgcatttattgatttggtgttaatatctggtatggataggttcttgccctcgcttgttacatgcacatatccatgatggactatttctccaaacttaatagaaatttgatacctctatcaaaagatcttttatcactaagacatgttaggtgaagagcaacctcaagtattaccaagatagttaagattatctataacagtagttgtggctatttctttgtcactgaaaagtttgcgctcatcttttttgcttatcttgaatgcagggttttcgaaagattgtgcctgacaaatgggaattcgccaatgagaatttcaaaagaggacagaaagagctcctcacagctatacgccgtcggaagaccgtgacatcaatcccagctggtggaaagtctgtggcagccgggacttcagcatctccggacaattctggggatgacataggttcaagttctacctcgtccccagactccaagaacccgggatctgtggacactccgggaaagttgtcccagttcacggacttgtcggatgagaatgagaagctaaagaaagacaaccagatgctgagctcagagctggtgcaggcgaagaaacaatgcaatgagttggttgctttcttgagccagtacgtgaaggttgcacccgatatgatcaaccgtatcatgagccaaggaaccccatcggggtccagccttgaagagttggtcaaggaggttggtggtgttaaagatttagaagaacagggtagttataatgacaacgatgataaagaagacgatgacgaaaagggtgatactctgaaactatttggtgtgttgctgaaagaaaagaagaagaaaaggggcccggatgataatattgagacttgtggtggacgtggtaaaatgatgaaaactgtggactataatggtccttggatgaaaatgtcttcgacggccggagaaagcagcaaggtttgtaactgaggtgaagttggtgaattatgtgttgaggttggagcagagtaaattagcttctcccttttgatttagtaatttcctttggatttacaagttcgatgtttatgaataaaataaatagagaatttaattagtatgagtagtaaaaagggtttagattactactaagagtagtacacccaaaaccaactagaaattatatatatatagtacatgcagactgctattaagtcaaatgcaactcaagtttgctttgtctagtcagaaacttataataataataataatattggttcttgatttgtgactttggtttgatatgcatttagagatctggaagcatttcatttgggctgaatgtcttttgaatcttatttttttcgtaagacaagattgtgtacacatttatcattttacttgtgatattatatgtccatgataagtgtttgttttgtaatatgttttgaagcacaagtcttgtcatggtcttttatgtccatgataagtgttgttttgtaattttgttttgaagcacaagtcttgtcatggtcttttatgtccatgataagtgttgttttgtaatttgttttgaagcacaagtcttgtcatggtcttaattaacatcatgataagtatgttgtgaggttgacatttgacctttttagtatgcaactgtaggttgatttcataatcgatagtaatatgctcaactgttattgtggtctcatgtaccactcatactaatatgttcaattcacataatttactcttatttgaactgttttctacctgttacatgttcatttgatgcttcttgaagctaggttgtccaggtatatagcatgtttgattgagttttcaagaatttattttaaaaatttattctgttttggttcaattgatgcgagtcgattcaatatgacaattctaaaataaagaaaaattagtcaacccttgtgtagacagtagaatagaagattttttaaacttgtaatttaaagatactacaatattatgtggcaccaagacttttactaaaactttttgttatcttaaaatcgaatttattccagattttaatataaagatgtccaattcttcacggaatatagaaataaatgtacacacattggtgttggtcaagttttgtaacaaaagagaagatatttttgagtagcaacagaaattgtttttccatttctggaagcagtattttatagcttctctcttgaaaagaagagaatgattttttatatatatattttccaaaatgaaaatatcctcaaaaatttacatttatcgaattc

SEQ ID NO: 387 - DNA, 7242 bp, Solanum lycopersicum
agaatgtaaagtttttataatatactatgtaaaataactttaaattatttatgtgattgcaaaatatctcattaaaaaaaaattaaagtatatttctttatcaaaacaagggataatgtccaagtactccttcaacctatgctcgaaatctcagagacacactttatactatactaaagtcctattacccccctgaacttattttattaataatttttttaccccttttcgacctacgtgacactatcttgtgggcccaatgatggttgattttttttcaaattagtgccacgtaggctaaaaggcgtagaaaattacttataaaataagttcagggggataataggaccttaatatagtataagtgtgtctctggaatttcggatataggttgaggggtacttgtgcattatcccttaaaacagacaaaaacacaaatcttgaaacataaatcaacacagaaaaaattaacttcattagaaaataaatttaaattaccggttataacaagttaaaatacattataaaatattaatcctaatctctctctatttcatattaattgtccatattgctcaaaataattattctaaattattgtcaaacttacaaaaccacaataaaattaattatattacccccccccccctattttctcattaataacaattctttttaaaagtgtaaaattttaaaaataaaataaaatattaaaagaaataaataagtaaaaccccccttcttattagtgattatacataaattacaaacaattaaatataagacgataaaaatatctaacacataataaaattaatcaaaatacacataatctaatttttaaatacattataaaattaatcaaaatatacacaacctaacttctttcattctttgcctaatataaacacaatctctataattagaaacttttgcctatctaccccccaccccacccacccacccctctctacaattaggtcatcacacacacaaacatttctttgtattctggtttattctttgttccctcttttataaattccctctttcttcataactctcttagttctatttttggaaaattaaaaaaaaaaaaactcctaatggctagagaaaaaattcagatcaagaaaatagataactccacagcaagacaagttacattttcaaagaggagaagaggtttattcaagaaagctgaagaactttctgttctctgtgatgctgatgttgctctcatcattttctcttctactggaaaattatttgactattctagctcaaggtacatatccatcattttttctttcatttacctaattataacgacagcaacatactcagtgaaattccgggacccgaaaagaatagtaggtgtatgtaaaatcacctaattatccttattttttgtttgtggtagctagattagttgttttctagactaaaaaaaagaaattgggaataatttttgattagttattaaataataacgtatttagtaaaattttagaaatgaattttgagtaaagtgatgtgtatgtgtattttatctatagggtagagaggttttttccgatgaattttagggctaatttaacaagtgaaaattaaagtaatgatttttgttaattttttgtgaggaatgaagttttttttttttttttgggtattttctaaatgggtgactttagttagtcatgattgaggagaatgattagaattattgagttttggatttttgtaaatatagtttattaattaattattatattaaatggatttttaggtataaatttagggtttgattttaagttattgagttttgttgaattcttaggaaaagttcttcgctgttgtttacaaatgggtgtctttaagctagtcatgattgacaagaattatatcgagttatttaaattctgaaagaagattttgataaattgtttatatatgtaaaaagtgagattttataatataaatttaaaaatttgatcaaaagctattagatttcatcgtgcccgcatacaaatctcttctctattatttaacaagttatgtgcactgataatattactaatatactttaatttgttataataccaattaagttacatagtttaatttgtgtagaagttaagttactacttttgtcaagtaatttacttattaattactacatggttttcacataacataaacacttgctatatttagcaactattgagaaacccacctcaagaaactttctattttgtgtcatttattgactcttttttttaggtaaataattaatgaaaaaaacttgaattttgtattagaaaacaaagcttctaaagactcaatttttatttaaaaaggaatcagaaaaaatggagaataaacaataataccaacacaaaatgagtggtgtaggaagtagttagtagttaccaggttataagaattttatgttgtttaaattcttcaaaaatattattacattatattagatcattttataacatgtagtaatttttgatgatttgatgtgtcaatgtaaattttattcttttggattgaaaatatatattttcgcacacaatgacattattaaaggattcacagaatatatatgtcaatttcatttatgaaattcaaaaattttgttacattattaattaaattgacttgtaataacaaataatattttaaagcttagatagaacaataaaaaaataaaagggaataaatttagctggataatgttatcgaaagggccaccatatcttatctgtttcacagaaaggcaataatattatatcttataatataaaaataaatattatcatgggaactatatatttatggtgaataggacaaactccttttaatggggaaaaaaagaagcatattttaggaattttatgttttttttttgtatggtataagtaaaaagtaacaaatttgatgagctatttttttgaggtggttgtgtgtggtatataaaataattgttttccccctctacaagtaaatgttttaagaaagctataatgaactctcttcattcggtattgtttgtcataatttttatttttagagttaaattatgaaaattttgacttacattttaagatgtattttttaatcatattaatatgtaaaaaattgtaatttatagtattttccatataattttaggatatctaatttttttgtttaaaatatcgaattaatctgatctaatttacctttgaaaattaatcaagtgactttagataagtgcatcatgataaacaattccggacgaagggtgtataattaatctacattttaataatttgattttttttttataattcacttatttatcatcctcgatatttaagcttattgagtgtgtcatatatcaaagattaatagatcgtctttttatagtcttgaataatcttatacttcataggtttattacttttgaagttgagtcagacttatccttagctattagtattatgtcgttaagttgataggcctgctcgaatggggaagaggtgttatctatcccacattagttgacggatgagttgtttatgtcggtgttaagcaatatttttcatttgagattgagttagatctaaagtcaattttctcgacagaaattacaaatttgtcttttactttctttgatgttgtgttcatgtgtccctaatatattggatacatgacacatacatacattcttcaaaggaatttaatatttatgtatgtatcgacatcataattgatcacataaaagataactatatataattctaccgttcatcaatgatttacgtacgatcttaatatttttaatttctcatgaagcatgaaacaaattcttgagaggcgtgatttgcattccaaaaatctggaaaaattggatcaaccatcacttgaacttcaggtaattaattcatttatttaatccttaattacattttaattagtttttaaacaaatattttgtttattttgtttgcagcttgtagaaaatagcaactactccagattaagcaaggaaatttccgaaaaaagtcatcgattaaggtatatttatagttacatttgaaatcgactatatgtattctcactgttctttttagttcaattcataatatccatcatcacatacgtcaaacaaaagtaaaagagagacaagttaatttatatatatatatatatatatataaaaaattacgataataataataatattagaagttctctaacaagtagcatcgattaacaggcaaatgaggggagaagaacttcaaggactaaatattgaagagttgcaacaattggagagatctcttgaaactggattgagccgcgtcatagagagaaaggtcgggatttaacttatatatattgacattataaaatatattttatgttattagtgtaatttaatatgtcgtaacaagttataatcgatttttcccctttttaatatcttacacaacttacgttatccatgtatcagggtgataaaataatgagagagatcaaccaactccaacaaaaggttaggaacaatatcgtttaagtgatctggtagtgtataatttttgtatcgcaattttacttggttttcatcgacgctgataattgttattgtgaaaaatcaacagggtatgcatctaatggaagaaaatgaaaaattaaggcaacaggtatgcaaattttttaacgaatgagataaaaattgattattttactataattttagatagccggtgattactgaaatctccgagacatcaggttgaaatttcaataaaatctatgaatttgtagatgattttttcctatttccgaaatctccgaaaaacttaagctttttaaaattaacttttttatggatacacttggagtatctaaattattcaagacttcaataattatgttattaaatgttatcgttgatatatatttttaattttttttaggtgatggagatatctaataataataataataataataatggatatagagaggcaggagtagtaatatttgaaccagaaaatggatttaataataataataatgaagatggccaatcatctgaatcagtaacaaatccatgtaactcaattgatcctcctcctcaagatgatgatagttctgatacttctctcaaattggggttagtactttaattctttcttcttcttttttccggtctcgtttcgatctcgtttcgtatgaaagataaaagaaattattaatttcaattttaattttgtgaagaaataatctattttgaattgttgtgttgtttgtttttaatactgaaggcggaataatgatttttagagaacttatcctagaattattttgagataacttattttccgttcaaacgaattgtggtcgtgaaaaaatattcgtttatcaatacactattggtaaattgtatatcaagtatctaccttctgaaggtgttgcatacatattaccctttttaaactttacttcggtatcatgttattgtatattgtttatgtaaagggacaacaaaagttaggggctaatcgagttcagtaattttgactcaaatatgatatttgtgggttaaatttttttatgaatattttattatcgaaagtagaagtctttgtacggatttgaatgaaccaaatatctttagttcatatctttgtattggtatttagaatactcataaatatgtacattttttttttaattcaaaacctcgttactaacccttgatgttgttatcttaaaatttagaacgtatacgtaatatttaaatttcaactctgttctataggttcaccttcatgttctaaatttataacccataatacataaatttaaaattctgagtccgtttctgatattatattttttttcatcttatttgttttttaaatgtcaggctaccttactcaggctgaagagatcaaaagcaaggtgtggctatttttgtatgttattagaagaaggagaaaaaaaaaagtaactactaattattataattaattaatgtctgattaatgtaaaagctaaccccaaaaatttcatattatgtatgtaattggtgtattaatctcatgtattcgtctcccatagtttatataaatattattgttagtatctattaacttaattaactagcactaataatcttttataattgaactttgtgacttgtaactatataaaggcttaattatttaattatttgacttttttctgttgctgtaaatttaaatatttacttggtgacggtaaactatacttctatctatattcagtgttgaacattagttatttgaaatttttagtggatgatttataatatgttattgtaagaataatttaatttaattttttgaatcatttccgtatctagcactaattaatttgtagtccttatcatgttcatatttaatagttgaagacatgcataaaaacaattcaattacttgagtttcattttcaaaccattaggttgtatatgtttcttatccaaattataataaatcatttatagaaattttaacacaattattatgtgtgtacgtttttaattttttttaatcaaaatacaccttaactataaggagtgtgagctttctaaactatttaccaaaacacatttcaactatcaaatgtaccgattttttttatctaaaataggaaaaaacttacccgcagaatgtttacatcaaagtcaatgcaatttccgttattatgtaatttaatgaagtaaaatgaataataaatttcaacacatgacatacatatattgacagtgtaaatcttcgacgtggttttacccctaaaatattatcatcatttgagtaaaaagataacaatattcgatacttgatataccttttaaaaaaatcaaaactgttgcaaagaaagctcagaatataagaagaaaaggacaagaagtataagatagaggagataattttcttattcaagtatgtattacaaaaggtgaatgatatctctatttatagagttgagatatcaccccaaaagcccccatgataaatgtccaattagtaggtacatagttatccaaatgattcttatcaccttgggaacatgtatacatgaatacaattaagtcttgagtaaatctaaaggataatccacacaatccaatggatttataacacttccccttggatgtccatagattatgtgcctcgttaaaaccttactaggaaa

SEQ ID NO: 388 - DNA, 9952 bp, Solanum lycopersicum
aatttttacttctcaacatttttttggcatagtatataaatttatacacttaaacttgacatcaattgatagttaaatactctaactttgattacgtacatttaggcatcataacttgtctatatcttgtcaattaaatactctaacttacaaaatgattacttagataccactgaaaatatgtgtgccatatcattatcgagtatttagagatactacagatacaaaatatagtgtttggttgctagttgagatcaatccgatgcgtgtactaatatatactcatgaaattagagttcttacttgacagttacgtttaatcgagtatctaattatatattatattttttttctcattttaatttttatatcattcttatgtgtatctctgaaggtagaaagtttacggatttttttaaatcaattgcttaatatatataatactatacttgttcttattcattatctttgaaggtagatatattatttttgaaaaaagtttaaatcaattgcttaatatgacattatgttcatacttattcgaatgattgaagatagagagactattttcgaaaaaacttaactcaaatgctttatatagtattgtactcatcaatctaaatattatactcattcttatgcgtattttggagaatagagagataatttacgaaaaaaattaaatcacttacttaatgtaatagtcattcttatccatatttttaaaaatttttaaatcaatttcctaatatgtataatattatattcagtcttatccattatctttgaaggtagaaggcctatctcggaaaaatttaaatcaattacttgatatgatatcgtatgtattctttacgtattttgaagatagagagcctattttatgaaaagaaattaaatcgattgacatattttttttctcaattttaataccaaaaaagaagttttgtataaatatatatacctttttgggtttagatagtttttcttaatatttactcataaatgattttttctctctctaataaaacatactaacatttttcccttaccaacaacacacataccctttttccccttttcctctcattcttcttcttctcttcctcttcctcacttttcgtttgcactgtgttaatggtttgcaccaatcgtcactgtcattgaaaccctagtttggatacttttctttgttgtcaggtaagacactgtgagtattactgtttctagggtttgttgggtgggtcgggttagaaacacgagaatcgggtttggggttgtttattggggtttgtattgaagtgggtttcttttgatttcggttattggggtttcttattgttgatttatgatgaaagttctgattttttatctacttctcttaattgattgattggtggatctgttgtattgtaggatagagattgaaaaacacacagcaaagctgttctctagggtttgaatttatgtcccacaatcaatcaagggctgacactcgcgagtcgtctcagtacaggagaaccgcccgatccggtagctttaatcagcaccgcggcggccgaggaagtggtggcggtggcggaggcgccgcccctcctcctgtttcttcaacctccaatccatctttgacttctaatagaaggtgagtttttgcttgtttctgggttattttctgaaattgatcgttttgtaaaaataaactagggtttttctatacttactggtgattcttggatatccattgttgtttatctctgttagtttcaacaagaagtattataatgctcaaggagggcaacctagggtaagtggcgttggtgctggctctgattctcatctgaatggtgctcatcagcaacaaccatcgcatggtatgtcaattgaccataataatctttttgcatgcatatcaggcttgcgaagtactagttttactagtttattctgaatgctgagatgggttctataggtttaaagcttactgtttgtgataattttgtataatgtggttcaatatagagtattagtggtacttttgttttacttcaactcaagtatagttcactttatcttgttgcaggagtatcagatgtttctgttgctattgcgcacacacctcttcccagtgctactgttaagccaactgatgcttcgactcaaaaggttactcgagcagtgccacgagctccaacttctaatgtcgtccctccaatctctgagtcgtctgcacctgtcactcctgcaaagagtatcttctcagtctttatacatctacttgtactcttttttcgggtggggttggtgggggtggggaagggttgacaacttgtttgtgtaggaatattgacacttcttatgtatatagttgtagttcctactattgaatgatattactttctgattttctagatccaggagatgcatctaagtcatttccacttcaatttggatccataagtcccggtgtcatgaatgttcttcaggtatttctagactccaccatgagtggtgttctcttgtgtgtggttaatttgaaaactttcgtgctaataattgaaggtatttgcttttacaatgtgtacagatacctgcgcgaacaagctcagctccaccaaatctggatgagcagaagagagcccaggttttttcatcatcttcttcgtttttgtctgattatgaattttctgatacccgatctgaataaccgagcttgtaatttagcttctttgtatttgttggaacaatatgatgttattcttgcccgtggagcaatctagtcctgggccacagagtagcttatggctctgattcattaatttatttcgcaggctcgtggtgacacttcaagagctattccttcgttgccaaatccatccacttccaagcagcctatgccaagaaaggatgcaggacccctcaaccaatccaatcatagtgaggcttatggggtggctaacaagcccaaaagagatgtacacattttagctccacctcctgttactcaaacacaaaagccttctacacatcccatgcctggaatgcacatgcaaattccattccaccagccacctcaagttcctgttcaatttggtggtcctggaccacaaattccatctcattccatgtctgctacatcattaccaatgccgatgcatctgccaattgtcaatccacctatgcagcagccaatgtttgtctcaaatcttcaaccccacccaatgcagtctcaagggatgatgcatcaggggcagggcttgaatttttcatcaggaattggggctcagctgcctcagcaattggggaacatgggaatgaatatgccatcacagttttctccgcagcaggctgggaagttcctaggtcaacgtaaaagtgtgaagataactcacccggaaactcatgaagaattgaggcttgaagagaggtcacaccctaatatgccacctcaatcacagcctattgcatcatattctcccagtcatcctaactattatcccaactcttataattccaattctgtttactttcaagctccaagttctattcctctcagtaacactcagagttctcagccaccaaggccttttaatcaggttagtcgaggccaaatcctgcatggaattttctatctcaattctctttatgcttatcactgaaatcagtacctaagagttttatttacttgcaattaattttttcgtgcatgctcacaacataatgtatcttgttcatgctaatcaactttaggtgacagtgaaaccggctgctggaggaatacattcaggaaaagagcagttaccatctgttagttcttcttttggaaaagatccagtgaggctctcaaagccatgtggaggagattcagctcactctcagaaagacgcaaacacttcacatcaaagctccaccactcagtcaaggactggcgatggctcaaaatcttcttcaaggcctgtagaaaatatacaatctactaaaggggctgattctatctcagggaagagctcagcagctggcatattgtcattgacctctcaagctcccattgagtcttcaacatctctaattagagatagtagtgtagatgcagctagtgaaacacttggtggcccagactccactgaagatcaaaagaaaaaacaagtaactaggggacaattgactgttcaagataaggtatttatttgcatgcttgataaccacatcactatactatctcggtcctacttatgactggaagttctttgcaggctcttgggaaatgtacctcagtttcaattcagactccccagtatccactaaccacactcgttgaggtcaatactgctgcctcagtgagcactgctgtgaacactagggaaagtctatctctgtcagagtccgctgaattgagaagtcatattactggaaattgtggaaaggaagatttgtctgaacctttggattccagaaatcaggatgcgggcaaaccagtacttaaaactggggatagaaatgaagtagcattgtctaaggccgggaagcaggacgagaataatagcttgaagccaccttcagaatctcttccggtagaatctcctgaggtgtctggcctaactgaagggggttctccaaagagagcagcgtatgccaatattgagaatggtcgaccagaaattggagtggagcacatgaatgaatctgtagcttgttcaactggagttgatagcatagctgatagctttacatcatccacttctaaccaggattctactaataccgaggcttgcacatcagcaattggtctatcggctcaagatgatcaggaatcagatattgcggaccccgaagaagctcctgttacaaagtcggttgacgcaagtcaggagttcgcctctgatttgttgaagagttctgatgaggccacttcaaagagtgaagatgaaaatactgaaactagtaacgccggtttagtttccaagtcgtcatctggcgtcaaggagaaatctttggtggattccaatgtgcctaaggtcactatgtctaggggtaaaaagaagaaaaaagacttatataagaaggcagatgctgctggtgcgacttctgatctttatatggcgtacaaaggtccagagaagaaggatgaacttagtcaatcaatcgaaaccattgaactcacttctaaagatgactctatgcctccatctgccaatgtgcatcaggaagatcttagatcaactaagaaggttggtgaggttaaagcagagccagatgattgggaggatgctgcagatgtatctactcctaaactagaaattgctcctgaacatagaaaggttgatggtgaagatggtgatggtgtgactaccaagaaatattcaagagacttcttgcttaaatttgcagagcaatgcattgatattcctgagggttttaatgttgctcctgatgttgcggatattctaattaacttcaatgccagtgctatgcgtgagccattccctagtccaggaagaggtactgataggccgtccagcggacatcgtgaacgtcgcggaagtggcgttggggatggagacaagtggaataagatgcctgggcctcctatgcctggtcgagattttcagccagacattggctttgggggaaatggtgtggggttccgacctggcccaggaggcaattctggtgttctgcggcacccgcgaggtgcaatgcccattcaatatgccatgggtcagtatgctgtgggtcagtatgccatgggtcagttagccactgggggaatactatctggaccaatgcaatccatgggtccacctcagggaggaggcctgagaaatggagttgatgctgacaggtggcagcgtggaactgctttccaaaagggtttaatgccgtctcctcacacacctgcacagaatatgcacaaagctgaagtaaagtatgaagtaggtaaagtaacagatgaggaacaagccaagcagagacagctgaaagctatcttaaataagcttactccccagaactttgacaaattattccagcaagtgaaagaagttaatattgacaattatgtcacactcaaaggtgtaatttctcagatatttgacaaagctttgatggagccaactttttgtgagatgtatgccaatttttgtcaacacctagcagccgagttgcctgatctgagtgtagacaatgaaaaaatcacttttaagaggttacttctaaacaaatgtcaggaagagtttgagagaggggaaagagaagaactagaagccaatgtaactaacgaggaaggtgaggtaaaactgtcagcagaggagagggaggagaaaagagtgaaagcacggagacgaatgttgggcaatataagactgatcggtgaactttataagaagaaaatgttgacagagagaattatgcacgagtgcatcaagaagttgttaggtgactatcaaaatcccgacgaggagaatgttgaagctttgtgtaagttgatgagtacaattggggagatgatagatcatgccaaagcaaaggaacatatggatgcatactttgatatgttggagaagttgtcaaataacatgaaactttcttctagggtgaggttcatgttgaaggattcaattgatctaagaaagaacaaatggcagcaaaggagaaaagttgaagggcctaagaagatcgaggaagtgcatagggatgctgcccaagaacgacatgcacaagctactaggcttgctcgtactcctagtctgggaggttctagtagaaggggtcaacctatggattttgttcccagaggagggggtatgttgtcttctccgggctcccagatggggggtttccgtcctatgtctccacaggtccgtggctatggcatgcaggacgtacgggtggatgagaggcattctttcgagaataggacattatcacttcccctgacccagaggcctcttggtgatgatccgatcacacttggaccccaaggtggtcttgcaaagggaatgtcttccaggggccaacctgctggaccaagcattgataatatgtcaagttttggagactctcgaaggatggtacatgcccaaagtggctatggttctttgtcagagcgccccctttatggtttaagagaggagcttgcgcccaaatacatgcctgagcgattatctagtcaacatgatcaatcaagtgcaccagaaaggaacgtgacatatgggaacaaggagcgtggatttgacacatctcggcctccttctccacttgtaagaagtggaggggcgacttccacacaaaatgtggctcctgacaggatctggccagaagaacgtctgctggaaatgtctatggctgctatcaaggaattctacaggtacttctgaactgattattatttacttgcattttatgtgttggtctgactatggtttatgtgctctgcacaaattactttaaatatgttggtttatctacttcaaaataagtacccattctggaactgttttcagaaagttgcttctgatataagaagattttggttcaacacttggctgacttattcacggtatcatcaggaatgtctaaacttttaggaagcataagcttatgatatggttcggcaattatagatcttgataatacctcttccaaagaagatgtttactagtctttttcttttgtggggtctcactacccatgaaagaagcctttttccaaccaaaaaggagaagtttaaatttggaattcagcgaggaacattaactttcaagtatatctcaatagtatctgcagtaatagcatagaaagcccgttatgatcatattttaggtttgtatgcctccttgggaagtttgaagcacaaggtaccttgttattttgttatctgaggatggtttagtaggagaattttctcactgtatgtttcagaacgcgtgtctccccagtatccaatttttctgtctcctattgcaaccaagaaaattataatttctaatttctagtaatgaagatcacataagcataggttcttttagcatctgtcatcttaaacttcatctatagtagcaaagttgaatcctccttgtaccctagtcatgaaccatagaagcattctatgcaatttatttttggtacataattttgctaaagcgtattgcgacttaattgagtttattattaattaaattaaaaccttttcatttcagtgcgaaagatgagaaagaggttgctttgtgtgtgaaagacctgaattcacctggcttctatccatcaatgatctcactttgggttactgactccttcgagaggaaggatatggaaagggatcttttggcaaagcttataattggtctaactctttctcgagacgtggcaataagtcaagatcagttaattaaagggtatggagttgtgctttttcctattaataaaaattagaatgcaagctcttaaatcacttggattttgtgttcaactttatgtttttgtttactctttcaggtttgaaaatgttctgactagcttggaggatgcagtaaatgatgcccctagagcagccgaatttcttggtcgcatctttgggaaggtaatatcggaaaatgtgataccgttcaatgaaatagggagtttgatatacaaaggcggagaagaggaaggacggcttgtggaaatagggcttgctgctgaagttcttgggagcacattggagatgataaaggtcgagcaaggtgattctgcagtttcggagatttgcagaagctctactatgcggcttgagaactttcggcctcaaggttcaaagaagcaatggaagctagacaaatttatttagggttttaataggtgggggaaggaattgtatcttggtagagattcatgtctagttttaggccacattttaattttgcagatatatatttaaatggtgatcaatataagggtttcatgtctttttttcttttcttttttcggaactgcagtagcaaataggatcaactcaagtgtttttttaataccatcattataaaattataattttttaagaagaaaagcataggacatgttatggaaaactttttaccaatctgcatataaaaatgtagatctgagttatcatattatttgcctgttttttcattcgaattcttccattttttaatggaaacggttttataaaaaaacgcaaacattattttttcctgattaaatcagctatgtctcatttttcaaaagttaataacttttcaaagtaaaatctcataaagagattaactaaatatttcaaaaattaaaaaatactattcattatgattcttctcaaaaatattattttacataatttgacaattgacaaaaagtagtttccctcctgggaaattggaaacaatcagattgtcagcaacaccaaagacaagaggttagagaatcaaaaagatgggatcacacatattctagtccgtttggaatctcaaaaccttaataattatactcttatttatatctcgtttttactagaaatataggtttctttagttcttttcatcttataaatcaatgatacttttctttttattttaccttttaaccttgaaaaaaatatacatttgattaacaaagaaaaattaagtaaataattcgtgtttattgatcaaattaattaattgcaaaataaattgattcatgttcattaatcaaaaatttgactttaagagaacactaaataagggaacattgataaacttacctagtttattaagaaacataaattgtataatagtgaatggtgataactaaatagaaacagaaggagtatttcagtctcttcaaattatctatcgcgattttcatttacatatttataaataaaatgtcaattttgaaagattgactattttatacttatctatgtcttaatatatactttttttcactaaatatttactttatttatgtatcatcacta

SEQ ID NO: 389 - DNA, 6079 bp, Solanum lycopersicum
ggaattagtatgaaaatttgtacggaacttatttttctacaaattttcatactaattttctgaaaaattcccatataatacatagttttcttgtagtgcagtttgccaatcgatcacagttattacaatattttttggaatcgtttggaaatgaaattattttttattaaaaaaatcgatcttaaaaatgaaccttataatacgcatatattcataattaggtaaatcctaacaaaaatatcagacgtgaaattatgtgatcagtacaatataatctctggaaataacataattttaaatcaagtggttaacacaatttaattaactagtcttgataatctattaaacagaatataattttttttatgttattaggcctacccacatgaaaagagtgtcagacacatcaaataattaaataaattaaagtgatgagacacttaatataattcaactaatataagaaaaagtttaatctataaatgaataatagatctattgctatagaaagctaagtacacacttgcccaaatacaaaaaactattgttatataaaaaaaagtcatcaagatctttataatattcctacaagttttggatcatcccattttaatatatccttcaatatttctcgctaaatttacgtgacataatttaagatcagatatatatctaaaattatatatatacaaatttaatatatatttaaaatatattttttaaatttaaaatttacaacgtctaaattctttaattccgtaaatgtggtaggttagttaaagtttgttataaataattataaatatgccaagtccgtgtgtgtgcgcgcctatttctattatataaaaaatatttttttgataatgatataaagccttcaaaaaattgacaagcattttcaaaaaggcaatcaaattctttaatactttgtctctttttttatttttatttttatttttccttcatagtactttaatctttgtttataaatttactatcaactttcttttgtcagttttattgtttttctctgcctctaaattccatttcttttttttcctttcttctttgtataatttcataattcagttttaattattttgaaaaactccaatttgtagaagagtttctttgtacttatgaacaggttagcccctttatttaatttttcagtattttttttctttttagtattaatggtttgcctaaaaagttgaattcttgaattatatatcatataatagttgtacttgtatgtttttgtgtgtgttttaaggtgaattcgtttacgtcgaaaaattatgctgtatatatgaagttatttttgttttaggtatacatagtatatattgaattctttagtttgacatattcatatgttatgtttgcttgttagtattttaaagttttctttattgaaaattctgactctgctgctgttgtggtggtgtgttagccttgtatattagaagtctatttatttgtgttaattttttatttttttttgggtattttgtgttttttgtattgattacatgaaataatatggatgatttcaagttacctttaatttgtggtttgatgagaagcataaaaagctattttgaaatagctaacaatttttgaaacagagtgtttagtcaagtttagattcttcactttgataagttctatcaagtttgatggatctccttattggagtctctattctatttttcgtgttagacggagtggacgtatagtaggtagtgcagcgttgtcttacttttcgattaatttggcttggtggtgtttgtcgtagtactagacttgttcttgtagtatttatcttttttatatctaccatcatctgttgtttattgtgtttaagttctcgcactattttgttgttgttgttgttattgttccttttctggatgttttgcactgcgtttcgttattagttgctatgttttcttcactatcgcttttcccttttcataactactttgatttgttgttatgaagccgagcgtcctttgaaaacagtctgtctacctccacgagttaggggtaaggtcgggatacactcgaccctcctcagaccccacttgttggattttactggatatgttgttgttggtagaaactcaattgcagtttatatcatgtcatcaatgatcaaactataacgcgacttgttcggtgatttcatagctacaatttgctgtatcctccagaagtgcctcatgtatctcataatccgaaaaaatacctgtttgtttgtcgtccggtcatttcttagaaatgattttcgtagctataactctgttaccctctctgctctgcagtgatctaaaattcgcgtctaagatatgtgatctttctttttgattcagtcaatgaacatgagttctacatcaactcagtttgcccccacgagaaggatgggcatattcgaaccattccaccatatgagtatgtgggaagacgcgtttagaggtgatattatgcccagtgttggtgcgtgtatgatcacaccggcaaatgacagggcagatgacaaggtaaagaaccatacatgcatcttctagctaataaaatcgaagtttctatcgttattgaactgatatttatggttattgtagtcgggatatacttctagtgaccaacttataccatctggctctgaggataatcaagcaggaaagagtatttcagacaaggtgggcataacatacctttaaatctctagttatctctcgtttccgtgcttatatgttttaggtgaaagtattgaaacattcgtgatatacgcaaaacgaatagataaacgaaatgtacctctgatgttaaaggctaagtatatttgcatattgaaagttaggtacaacggcgtctagcacagaatcgtgaagctgcacgtaaaagccgtatgaggaaaaaggtatgtgaaagttttaacatttcttgtgttgtagatatttgaagaattcctatcttgattcgttttccaactcttttcaacacaggcttatgttcagcagcttgaaaaaagcaatttgaagctagcacaacttgaaatggaacttgagagagctcgacagcaggtcagtgaaattctctcctgcgcgtttctaacttctatgcattatcatatcaacttacatcacgtaattaatttatcgcagggactatacattttaggttcaaatggtaatatggggctaagttcaacaattaatccaggtttgtggatactggacttgtcgcttaatagctcatttttcattttctgttcatgagttagtttaacttatcaactgttttagattcttaatgttaactcagctacacctgctcaagtctcttgcgtaaaataatagatacttccactttttcattaggtaatgtcacgcgctgttgtctagctaagatcttcacaatgtcatgtgactttcttgaaaacagtgtgtgtatcgtgaattttgttcctaactggtgttgcctatgcaggaatagctgcatttgaaatggaatatagtctctgggttgaagagcaacaaaaaaagaacgtagagttgaggaacatattgcaatcccatgtaagcgaaatggagcttcagttgctggtagaaaccgtcttaaaccactactacaatctattccgaatcaaagctgatgctgcgaaagctgatgtgttttacttgatgtctgggatgtggagaacttcggtggagcgttttttcctctggattggaggattcaagccatctgaactcataaatgtatgtagtccttgctgcattttcactgctctgtagcttagtaatattcgtttatcataatctgactcatagtgtagcttatacataaatatcctgaattagtcatcacacctatatacataaatgtctcggagtcgtcatattgtcaatctatgtttaaagaggctcccaaatttcctctcatgttttcttgtgacaacaaactcaactcttaccgcgactattttcacatattattcttgctgcattgattgaaattctcatttagttgcatctctaacattcaccgtccattagtcccattcgtatcctttttatctcttgcttgtgttgtttccttaagttctgcctgcaacttatcaaataagtgtgagatttctcattgtaacgtcaattttatagatcgtgatgccacagcttgagccattgtcagatcagcagatcgtgaaaatctgtaatctacgacactgttgtcagcaagccgaggatgctctcactcagggaatggataaacttcagcaaactctggcacagaacatcctaactatgaccactggaatgggaagttacagttctcaaatggtttctagtatggaaaagttagaagcactcgagagtttcgttaaccaggtaacactttctattactcccctccgtttcaaatttttgtttgtttggtttcgacttgacacagagtttaagaaagtaaaaacgacttccgaatcttgtgatcttaaacaggcagatcaccttagacagcaaacactacaacaaatgtcacttgtcttgacaacacgccaatcagccagggggttactagctttcggggagtatcttcaacgtcttcgtgctctaagttctctttgggctgctcgtcctcgtgaacctacctagccttttacgagcaaagcagacgaagatcactaagtttcctcgaatgtaagctgtttaactacgcctgaacgagatgtatatggaaaatgtaatcgaagtcttgtctagaatttcatactcggaaaacgcgtattattcaggtggtaccctggcaagtttcaagaattttatgtacatagggaagggggatgtgtataattctagaataagaacttgatgagagtagagaaattttaactatgaaactcagagaaatctggaaaatgtaattttaatttttacatatggtgtaaactgaaaaaaaaatgtattatggagagagtgttctcccacttgttagtttgaaaaagagtactccctcctatttgtatctgattttacaagtaataaaatatcctcatatcttttatcattatcagatattcattattgctaaggttaagtctcctaatctttgttgctcgtactctttaaaattgaagtatttgatacgcattcattgacacttttaaagacataataggtgcacaaatttagcaggaaaatcataacctgacatgcatccatcgatattttaaccacaagacataataaattcaaataaattcatcgatattttaaccacaagacataacaagtgcacaaattcagcagaaaaatcataacccgacatgcttctatcgacgacattatgcatctatcgacgccattttaacttttgacgataaagtaaagaagacggacatagctacatatccatggagggtacaacagtcatttagctaattctttttgctccaaatgtaacgaaataaaccgtccacataattaaagagaatttttgaggaaacaaaaattttaaaattaattaaaataaaattcatttctctatcacttcatcaaatcttcttactccattaatggcatagaaatctgaaatactctgtgaagagtgaaattaacaatcaaaaatccaaaattatgagcaatttgagatcgatttgtagacctcaagttgtgtatttttcaattacttgttgttgcagagacttattggggaaatcggcagttagggtttcaaattggaaccttagttcagtttctcgatggactaaaccaccggtgctgcaatcatggtatcatacttcgagtagaatggaaacttgggatcatcgattgaatcagcagaggaaaatggtgactacttctgcttataattggaatgattcaaagtctccttatgaaactctcggtatgtttgaatattgaactatccctcggtttcaatttgtttatccgattttgacagaacagggagttgctaaaaaaaaggaggtaagacgaacaaattgaaacgtaggagctgtagttggcttttaaatgatttaatagttatgaaaagaaattgtactatttct

SEQ ID NO: 390 - DNA, 8563 bp, Solanum lycopersicum
tgacatcttgtcagttcctgtttcaacagtaacggctgattctatatttagcacagttagcaaagagatggatcactacaggtgttccttgcgtcctgagaccgtggaggccctcatctgtgccaaggactggcttcagaatgcatctttagacacttcacctataccaataaaaatggaagttccgatttaggtcttggttatgtgaaatacttgtctagaatatagctctattagccatattgatgttttctttaagactattaacattcgtcgagtcgtctgagaatcaactttcttgtatcataatttggtacctctagtcttactggagagtttagtccccattttcagtctctttatttactcattgatgtctgaattctgaatgcatgaaaatcagcttactggtgcatgatatgaatatgttggtatagttatgctgctcaaatgacttgtactttctttcattcttctgtgttttgtcttcttttctggtctccccttcgtagtttggaggcggtgggatgtattaagatcttaacaatatttttgtgtggcaaagagattgcttcttattgatccgccggttaaatttatttatcttagaaatcaatgatccaaataatttacatcgtgtatttatctttaaaattttcaatttttgacactgaaaaatgaagtgcaacttttaaaatttatcagaaaaattatattttttgacaaacaataagtaaaatacaaagcaaacaatacttaatgttggacaaacttgttgccacacattttctcactggaaaactatgtattacactttgaatacaaaatatcatttggttgtttggataatattttttcttcagaggaccaaaaacaatgaactttgataaaattacttatatagttctttttttttggaaaaaaataaaataaaaattatagttcgttgagtggttatcctcaccccataaaattacgaataaatctcacacacacggcacaaatccaaagacaaaacacacagatgtgtgtgtaagtgtgtgagagagaaaagggaaaatagttagttgaaacaaatttgtgtcagctgtagagatatctacgttccgaaaccaatggctaatactactcccaatattacaaactccgttggtatcggaatccgaatccggaccaaaatccgacccgcatccacttccatggcggctactccggcggctttatcgaccggtcactgcattccgaccggtttgctcgttatcaactccggtacgagtcgacggggaggagctgctcgagttgactcagttaatggtcacttgactcgcagccgtgcgtcctcgttttcgattcgagctgcggcggaggtggaaccggtcggaactagttcttcaggtagacttacagtgtgcatttctgaataaatagtgtattttttaaatttgttttagtcaattaagtgaattaggagtggtatgttagttgattgaattgaagtcgagcataagtattatcgaaattcggaattgcatttgaaatataaaatgatgctggttaattttgcagctggaaattgctcttttgggttgattttgcagctggaaatagctcatttgtcagcagtttatatgcaattagttgtataattttgagaatactggtgtttttgtttgttccagctcagggtattgaaaacttggtaataataggatcaggtcctgctggatatacagcagcaatttatgcagctcgggctaatttgaagcctgtagtgtttgaggggtttcaagctggtggtgtgccaggaggacagttgatgacaacaactgaagtagaaaactttcctggatttcctgaggggataactggacctgacttaatggataggtataagaaaagtttttgagcatttactctcattaagatatctatttgaagtttccttttatagacaaaagttttgttgaaggctgagaaattatgtaattttggtaggatgaggcgacaagctgagagatggggagctgaattgtatcaggaagatgtggaatttattgatgtaaagaatgctccctttactgtccacagtagtgaacgtaaggtgatgcatcctttagttgctgattactttgtctaggttatgttataactgcttaaatctttaatccccatcaaactgtttgcctattctgaattggagcatcttttaaaattccacgcaagaacaattctaatatctgatgttttaacaaattttatggggtaaagaatataaggatggccatcatttatcaagaccccagcaatctttttttcttttcttgagtgtcacttttgaactatttaacagttcatgtatttttgtcaagtttgcaatatgttctcaaaacagtgcccagaaaattacaggaagttagatataaacgtatgtattctcatttggagtgagaactgaaaagctaaacagatttcagacgtgtaatggaagaagagaaatagattcaacatttttccttttcttggataaaaaatatattatgctattacatagaaggcatctaagctcgtactttctgggttttcttattcttctagacagaaacattttctttccaataaaaataattcttttcaaagtacagagacattttaactacaccgggacttctttatgggtttacgtgttttccattcggaagtggtttgattaagtacaagtatacaagtcgttttctatttttttagtatctctttcctttatgagatgtaaaagatgctgacatggtagaacaagaggcctcacaatttgctgcattttttagaaagatcaatttgctgcattgtgtaaagaacaatctatatcttcagagtaccttagccatgatataagagtctgacgtgttctctgtaccttatgaatgaaagaagcatcttcgattttgttttccgtctataatccctcaattctctgaggttcatctgatacatgagatggtcatgaaacatacatccatatttgtggtaccggcactcttttgattccctctgcaataacaaaagggaagggcgtgtttgtttcatatgttgtaagagatgttgggcttgaaatgcattagttcttgcagtcgcagatgccaaattaattccttaaacttctagttgtcttactccccttggtatgtagttcccacattaggcttcatatattggatcactgctcacttctttattttcaggtaaagtgtcatagcattattgtggctactggagccaatgcaagaaggttgggattaccccgtgaagatgaattttggagcagaggaattagtgcctgtgcaatttgtgatggagcatcaccacttttcaagggtcaggtccttgctgttgttggaggtggtgatacagctacagaggaagcaatatacttaacaaagtatgcgcgccatgttcatttacttgtccgtaaggaccaactaagagcatcaagagcaatgcaagacaggtaattgttgtgtgcatttcatattatttttccgttccaatgttatagcacaaggcattagaatttatcttaagatcgaggtcgtatctgatgggccatttttggtttctttgggagaggattgttagggtcatataatactctcatcctccataatggtttccttagtttagagggcttgatatgatgtagaataccttaaatatttgtaaagttgtcggtgtcactttaagacattgcagactgagagatgaataatttaagttaaaattgtcagtgtcttgcagactgagagatgaatgatagcagtgtttccaagtgtcatatcatggctgcttacaagtacgatacgttaatgtaatctttaaaaacatctagggaagttctcttgcgcttaagatatctacacagacatgcttcacctatattttgtcaaatcactatttactttgaatgtgctggttctttacttcaaagaaacatgtgcatatgtgccatctttttcgcttcttccaggccctgccatatgaggcacttacggtagaagatcccaatgatggttgtgagcttggccttgtcagaggccacattctgagatacatccatgcctgtcttctttgtgttttttagtactttatttcattatcttatcgagtacaatagacagttcctggaatatcgacttcataatgctgggaagggagtcaccaaagattatctcttcgattacacttttctagcacgtaatatggtttagctagaggcatttcaataaatactaattcaaaagggttcattgttgtgttgtacacactagtgaatgtgctctccacattacactatcatcataattttagttcagtatgcacctgcaagtcacattacgtgattgactaaagtaggtatatcctccagatgagtgcgttgatatataatccagtgtttcttggttggtttgttgctggttattttcatgtttgactcttccctagtttcaatctattgccgctattcttcttgtgctatacctatttctgtaacctcattctttgaagcggattgaattactaatgatctatatatttcgagtttcaactccctgaaatgtttgtttaacaggttgattatggggaatgtttcagagttttcaacaatccaaacatcactgtgcatttcaacactgagactgtggatgtcgtcagcaacccaaaaggccagatgtcgggaattttgatcagaaaagctgatactcaggaagaatctgtgctcgaggcaaaaggcttgttttatggcataggtcattcaccaaatagtcaactgttggaaggccaagttgaacttgataactcgggctacatattggtcaaggagggcacagcaaacacatctgtggaaggtgtatttgcagctggagatgtccaggtacttacagcaatttattatttcatttctgctgtgccttttccctttcttttaactattgttgtacttgaagtggtaatttcacacctgcggatgttaaggttaattatgcatggcccctttagatgtatcatgagtgtggatgaaaagcatgactctagcctggtcattgaaacgtttgaattaagttctcaagagaagtttcaaataagttcctctttagcagggacaggtgtggaatgagaaaatggttgtcttctctattataaacttaattttaagattctgcaatgaaagaagggagccatcccataaaaatataatgtgatgccatttatcagactttttcttttaaggattcttaggttgcctggatagaggaaattctcagaattgagattaactcataattggatagaacatttgcaacttctaatcatcttttttatttgcaaatgtctttgctacttcttatagtgagatacttcctaatatcaccatgaatgttctctgtcggtaggatcatgaatggaggcaagccatcactgcagctggctcaggatgtgtagctgctctatcagttgagagatatctgacaagcaaaaatcttcttcttgaattccaccaggtgtctgacttcgaaaaaaaactgatttttagtcctgtatattttctttaccagtcatttgatatgtgtatatagacatgctctcaaatggattttaagccagctcctgaacgctcttgacttatatctaatctttggattttcttcaatgaactcctagaccaatagttcatgatctaatgaatcttcctgaaccttattatctcatcagccccctactgaagaagttaagaaggaactctccgagaaagatgtacaagaaggttttgatataacacttacaaagcacaagggccaggtatgagatctaggaagcttagatgttcctgattgttatgtttgaatggctatttactatagtctgcatccctatctgataaagtttgtactgttttccctctcagtatgcattacggaaattgtaccatgagagcccaaggcttatgtgtgtgctgtatacatcaccaacatgtggtccatgtaggaccttgaaaccgattcttagcaaggtatgcaattattgttatagaaatcttaccggaagatgtttaacatttacgtgtcctttgatttaaccatcacaaccatagaccaatttgagaagagtggagtactatgtaccaatttgccttgtaaggttctgtttcaatataattttatcattttgaggaaagctgaggacttgaaatcttatgatctcaatgaagttacacaaatcctgagataaaccttaacctctgataaagattgtctaagagctttgtccttcaagtaacttgtattttctcttacttctacttggtaatagttgatcagattagctgctttgctgctgagtactggctttggtagtgcatacacctaacctgttgttgcgcttgtgcaataggtcatagatgaatttgacaaggatgtccaccttgttgaaattgatattactgaagatccagagattgctgaggcagctgggattatgggtactccatgtgtacagtttttcaagaacaaggagatgctcaggtcggtaacattttccgctcaaaagtataatttgcttaattttctatattttagatgactataatagctgttctcattcattgttgctagggttccatctgaatgaactttcagagtttcaccatacaccaaagtaaaataagtccaagtagtcattgatcaagtcttatgaacttgatttcataggaaatgcaaattcttgcaacttcactctttattttcattgtcctatattgatttccttatgttacctcaagattccttttactgtgacgttgatgtatcttaggaagataacatcttcgactaaatcctctcttttgcatatatcgctcattctccttgcctgattgctccttcgaaacactatttcatctctgctactcgagtctgtcatcaagcactgcactactcccttgcctcacttccattctccactaccacgacagtataaatattcatgtctaacctaacacctgaacataattttgggaatgggtactatctgttcaatattttccatgaaatttgtcaagaatgtactataactaactcaatggaacctcctcttacgacttgcaaattatcattttacttctatctactgtcctaattacctgtttttacgccgatcgttatataggaattcatgagtagcttgacatatactcgtgctaattcaacttcttgtgtatatgcaggacggtatcaggtgttaaaatgaagagagagtatagagagtttattgaagcaaataagtgaaggcttgcttctttgttaattatttgtacaacttccttttttttttacccttcacgaagttttacttattttttttaatgcatggtacccaaatcaattttgttcagaatggttgattgagtaacagcccaataccttgtattagctttattaatacgtagaagtcataaatcaaatgtaccttgtgtctcaaatttaaaaagtacacagagccaagaaactgagatcacatctctttggctagaagcccttatctttttccaattggtttagagcaaattgttttaaagatcttgacgatatcactaattaatcagttacaaaattagagaaatgttcagtttacattaaattaactaaagaactaccatcgaaatttataaccaacaaagtgaacttgaaaatgttgcatgcagcaatgctcaatgctattttttagggaaaaaatgtcattactacaagattcataaacttgagtttattgataagggttaaacattttcgagcaaaatttgataatgagataccaagaaaattgataatacactatggtacagacgttaggtttcagttgctagtttgataggctttaaaaggatgatttcaagatacagaatcagaagcgtcgggaacatcatctaggatgacaggacctagttttcctgttctaaataaagtaagaaatttctttgataccattatccgagcttctgaagccttgtgaggtatcttcagagccttctgcaatgcttcaaactggtgttcgattagaatctccaggtcagattcatcttccaaactaccactgaactctgagagggtgatgcaaagtgtgcgttggacttcactaaccatatcctgtgcacaaaagaccctcgtaaaaaaaaatggcaaccaaaaaagaagcaaagaatgaaaccataaacctatacagatcgatggcaaacatcttttaccaaactaatcagcacagctaattatcgtttgttttatacattaaaaggtacgggaaaatacagtaaagtagttaagaaaaccgaattctgaaatcatttctcacctgaactcggtaggcattagatttgttcatggacttctttcccttgttttgaagatccttgataacaccacatttgttttccaactcatggtgagggtccttagtttccctgtcaaccaagtgcttccactgaagaggagtgcctcgggtgtttaaaactgctaatagg

SEQ ID NO: 391 - DNA, 3878 bp, Solanum lycopersicum
tcaagggtattagctaaattgtcccaagatttgtttgttatgagtgacaaagaataataatttcatattaaaatgtagaattattttatcctaattttggtcaagagggtattagctagattgtcccgagattatttatctcaccctttgtagcatattgagataagttatctcatatatatgatagaataactaatcttatgaggtaactccgtcgataccatcacataccaaatgacccttaaatcttgtggttgtaagttgtaactaaatgtgtatataatatatcaaaatgttctttaatcttaagatgttaaacatgtcacgtaaaatattaaaaataacaatattccaaattatgaaaaagacattattttctatatcttaagtctaagaataaagttacccttattattagctatatcatttttttcatgatgataagtgataaactctaacaccaacaaaaacatgataacatatcgattttgcaactcgaaagtttgtaaatcttcaatttaaaccttaaaccataaatgtaatctgataaaatgaaagagaaaaaaaaaccttattagactctacaaaatatgctattataaattactaaactacttagaatttcatatcgatagagagatggaaaattaatcattgatcttccaataaattgtttatcgatgctgaccccatttatcatttattattggtgtgtacaaatttcaatagtccatacatggaaatatttaaaaataatttatttaatacaaaaacaatgtgggacataaggcattggcaagttttttccacacggtctcaacttgacttgtaaagcttaagtctacgctcgtttttcttacaatgcagccaaccatttctgattcataaaaaccgccaatacacgcttagaaaaaaaaaaaatccatcaaccaccacagtttccctcgttcacctctctcctccctctctgtccggtttaccggaaaaacaagaatctcaaatgacttcgaatatccacttttttcttttatacgttgtgagccttttcctttttgttcaagcaagattgaatctttatccaccagatcatgctgcactcttgcttgtacaaaaggacttaggcatcatttctgttaacaacccgtgtacgctcgcaggaatatcgtgcgagcgtagaccgggtaacacaacacaagttgtgagagttacccgtattgtattcagatccaacggattaaagggaactttgtcttctgctattggcaaactcactgagctcaaagagctttctctttccgacaatcaactatctgaacaaatccccgttcagattattgattgtcggaagttagagattcttcaacttcaaaggaacagattttctgggaagattccatccgaattgtcagctttaaaccgtttaaggatagttgacttttcatcgaatgagttttcggggaatcttgatttcttgaagtactttcctaatctggaaaaactgtctctggctgataatatgttcactggaaaaataccattttcattgaaatctttccgaaatcttcgttttctcaacatttcagggaatagtttccttgaaggtccagtacctgtcatgagccaaattgagcatttatcagcagatttgaatcgaaaaaatggcgttcctaaacgttacattctagctgagaattcaacaaggatatctgcaatgggacctgcttcggttccagctccagctccagcacctgtcaatcgtgttgtaccggcgatgcataaacgtaagaacaagaaaaggaagttacgatcttggtttcttggtttcctagctggaacttttgctgggggtatatctgctgtgctctgttccttgctattcaagatggtaatgttcttcgtaagaagagggaataacgattcaagtttaacgatatacagtccactgatcaagaaagccgaggacttggctttcttagagaaggaagatggagtggcatcgcttgaaatgattggaaaaggtggctgtggagaagtttatagagcagagctaccggggagtaatgggaagattatagctataaagaagattatccaatccccaatggatgctgcagagatcacggaggaagatactaaggcgttgaacaagaaaatgcgtcaagttaaatcagaaattcaaattgtaggtcaaatcagacaccggaatctgcttccattactcgcgcatatgccaaggccagactgtcattacttggtctacgaatacatgaaaaatgggagtttacaggatatcctgcagcaagtcacagaaggcacaagggaattagattggttgggacgacacagaattgcagcgggggtagctgctggtctcgagtatctccatataaaccatactcaacgcataattcacagagatttaaagccagcaaatatcctacttgatgatgacatggaagctcgagttgctgattttggccttgcaaaggcagttccagatgctcatacacatatcaccacttcaaatgttgcaggaactgttggatttattgcaccagaatattatcagacactgaagtttacagataagtgtgatatatacagctttggtgtggtgctagctgtgttggttatcggtaagggtccatcggatgattttttccaacatacttctgagatgagtttagttaagtggctgaggaatgtaatgacttctgacgatcctaaaatagcaattgatcctaagcttataggaaatggatacgacgaacaaatgcttttggttctcaagatagcttgcttttgtactctcgacaatccaaaggagaggcctaacagtaaggatgttaggtgcatgttaactcagatcaagcattagataaccaatacactggttatgtaactaagaatctgttctgtattttcagtttcgcaagttgatattttgttgtaattgtgttatacatgtcaaatcaatattcattccaccttgctacttaaataactaaaactccaaatgcaattatcatttgcttcttttcaaactagacatatcccaatgtgttatgtgtatgatcaagtttttaacattagtattggagtctagatgagttagcttttatcaagatgactcatgttttggaatttagaatacctctttgggctgatgaggtcattactccagtttcaaaggagcatcgaatcaatagttcaatactaatctccccagtcaactgacctttgatttcggagattagtgcaagagtaacaacaaagaggggttgaaattcatttgattgtaaagagagggatttcgcttcaaatctaaatgatttatcttcttctcttaaagacatttctatttaggacttgattgagggatcaattttctccaaaacataaagtagcacgatcataacccgtgtccccgcccctttaaaggtatggaagttcattgatgaatatgtataaccatatgcttataattaaatcacaagttggcttacaaatttgagaacttacagagcaagctaattgctgactcaattgaatcaatagaacgttccaaacatttggtaggaagaaaaaaaatgcataaaatgtgaaatatcattgagcctatctcatgttggggtgggtttgggccaacccaaaattcaaatcaaaatcctgtatacttggattatgaatttaacttttaaaaatttatgaattttggaatttaattctatgaatccaatttttagtccaatatacaattacatgatatggcggcttggagtctcaatctcgattaactatagaaagttactattatatttgaccgagaaaactattagatgaagtgaggttgtatattagagcttttaatatgagtt

SEQ ID NO: 392 - DNA, 3396 bp, Solanum lycopersicum
attacaaatgagactaacacacgtttgtctttattccttcgatcaaaatcattacaatacgatcacaattaaagcatttataatgaaaaacccgatcaaaatcagtcaacagtgtttaaaaggaataaattatgggtggttcaataattcaataaaaatatgacatagttaaggcacctaaagaaaaaccccaaataaatttagaaatatgtttatgagttcggcctattccatgagttaaaacatgttatgcatatttgcttttcttgattcaacatggaattctatatgtgtaaataatgatataccatcttaggaaaaattagcatacaaaacgcacgtattaaaatagacataatatataaatatattttttcaaaattttctcatatggaatctacggcctttaatattaagtgtacatatatgtacttaagcttgtattacgtttaataagtaaatacatatattctacatgactctataatacacataagatgtcacctaagatatcgcgtaggacgtacgccaatagaatatttctatttacttgttcaaatctatacgaatttaagtatttatttatgcattaaaaaatatatatataccaaataaagtcaagttaaataatacgtttacgtgctatgcagattaaaatcatataggcaaaaaaggatttctttttttacccatattttatgaagttatacagatgtaaagagaaaatagagtcatgaactagtaaattcaaacaccccttttagcttcaaatgtttcaaaactctttaacattaaagtgccacaaaaaaaggacacagaacctatgtgtgtccaccaaattcaacaattaattgaattaaagacaatttttctttttttcttccaatcacctccctttatttaaacacctatctatatatatatatatatgccccttattttcatatccatcaaaaacactttcatacaacaaaataacacacacacaaaaaaaaaaagtatggggaggccaccttgttgtgataaaattggtatcaaaaaaggtccttggactcctgaagaagatatcattttagtatcttatattcaagaacatggtcctggaaattggagatcagtccctactaatactggtaagttatatctgatgtatggtattcacattgagatctgattttcatatctgatgtctggtactcacattaagattcgatttccatatctaatgtctggtactcacattgaaatctgattttcatgtctaatgtttgatactcacattgagattcgactgaaattcctgttggaaaccatataggtaaagtattcaattttgaggcttgaatgtgaaacttttggttaaataataaagaagtacttagcactccaccagaaggacgacttccctagtgctaatattggtttatagttactttatgttggtgttataattatagggttagatttttcttctttctttatagaaaagattataattttctttaattaattgtttaattaagcaaacttattgttttttttttcttaaaagggttgatgagatgcagcaaaagttgtaggctaagatggacaaattacttgaggccaggaatcaaaagggggaatttcactccacatgaagaaggaatgattatccatcttcaagctttgttgggtaacaagtaatcttcttcaccttcttagttactttttttttactcattgtaattttaatcatacaattaaaaaaatattaaaaatattgaaataagtgtaaacagacagtgaaaattcatatagctgacttttcaacttattaaaaattgaaatgtatatgtttgtccagatgggcagctatagcttcgtatctacctcaaaggacagataacgatatcaagaattactggaacacgcatctgaagaaaaaactcaagaaattccaaatagaattggattcacataatttgactcttcctcctcctaatttagacaattctaacactaataactatgatcatcatcatcatcaattcacaaagttattgaactctccaaattcttcatcttcatcatcattatatgcttctagtactgaaaatatttcaagacttctagaaggttggatgagatcttcccctaatccttctagaagaaacaacattgatcatgatgaaatgttgcatgaggcacaaaaagaattacaagatcaagatggaggagttagcaatgatgatgttgtaataattccaaatgtgaatgttgattgtgaaagtagtgaagttgtcacacatgaaaagacaagtcctcctccattcacatatcttgaaaaatggctactagaagaaaatggtggtcaagttgaagaactcatggaacttccaatgatattcacataataatattaattatttctctttaattacaacttatgactactttttttttcttcttgtgtggagtttatttggggggcatgcatgcatggcctattatttgaagaaagcgtaatagtttactggttcatgagtaagatcaacgaaaatgatgagatcgtgaaaattgctttttcaagtgtatttagcagaacgttctaccaatcaaggaaggtttttaacttcatggcatgggaattgtactaatgttcgagtgatgaaataaggtttttgatgacaggatctggacgaagtcctttagatgtgtgttaagttttaagttaacatagagttctaattttatgtaacttttctaattataattaaatgttaaaataagctccatgataatacctttcttctcaaatcaaagtgttatttattttgtaaattaattgatcatagtttatgattatcaagctcattggtttgtaatttcttccataaagtaaattaaatgcaataatggagtatggtaggattttttttaaaaaagtagatatatgtaggaccatttaaaatcaatcatatatttaaatataattaaccatttgtcactaaaactattaaaaaatataccatactgttataattataaattgatatggttaagttttatgcactcatatcaattattaatatttttttcgttcagatttgtttgtcatattacgttttttgaaagtcaaattaattaattttcaaaatcaaaatagatcacattaactcgatattttaaacaaaaaataggtattctaaaactttatgaaaagtactatctattgtaattttttacatattaatatgatgaaaaaataatcttaaaatgttagtcaaagtttttataatttgactctaaaaataaaaactatgacaaataatatcgaacgaagggagtatcatattaagctattactataataagtaacatgtttaagttttattagtgtatataacttaaatt

SEQ ID NO: 393 - DNA, 7494 bp, Solanum lycopersicum
tacaacctaataatgaggaggtaacaaatataattgattaagattttatggttgttgtgatgacataggtgatttgtgatggtagagttgattgacgttaatagttgacgatattgatggtggtgactgaaaaaatgtgtagtgaattataaggtgttggtgataagccgtcgtgaaatgatttgtagtaaagattgaccatagtagtggtagtgactgagggtgatgatggaggtggcagcaacgacagtgatagtttatataattataataatagaggtaataagtgtgtaatctgtagatggtaattatccgtaatgattgtgataacaaagatggttgatgatagttgtggtttataatgatggagttggttaatgttagcagtttacaatgtcgatggtgattaaagaatgtgtaatgattaaaaatgctatttgtggtagttgacaatggtgttaattacgattgtggagataattggtagtaggaattgactgcaataacgctagtgattgataatgatggtagtgaatagaaatgatcgcgacaatgaatatacttataataatggaggaggaaaatatgatagcgactaacaatagtcgttgtcacctatgatagttgcaatgccattgataattggtgtggtggcggatatagacgatggttgtcgtggttgacatcgagtgtgattacaaaggtggttagtggtgatagttgacagttatgcacaaagtgtcgacgaaaagtcgaaaattaaacacaggaattatattaagactttattcaatatcttaccgattaaaatctatttcgaacaaataaatacttcacaattaaaacttaaatagggactgaagtgtatttttaacatagttgagagaccaaagttttaattttctcaaaatataataaaacatacttttagtattatttcatttcagtcctcataaatttaaaacatacaaataagtatacaaatacttaccaaattatcagtttcactctctcatactacttcttcttcttcttcttcctctgccgctcttctcttctccaaatctcttcgacccaatttttttcatcacctaaagaaccccttttcatacccaattcagcccaatcgccgccgtgcgttgttttcttcttcaccgtcaatggaatcagctgctgtgacggttgagtcagttgctgacaaattgaagaagcagagtttgggaaatgatggaagtaacagtaaacgtatgttgaaacttgaagagctcaattgggatcattcatttgttcgtgaactgcctgctgatccaagaacagataccattccaagagaggtttttttttctttctaaattccccctttttctgtttttgtttgtatttgcgttttttttatgttgtatgagattgggttttaattaaatttatgatctttattagattgttattgtaaattgaattgtttgaggagtgtgatttcaagttggggtgaggtaggagtggcctctgtgatgggcaaggtgagggatgtgagggtgagatgctttgggcgtatgaggggaagatgcaaaaatgtccaaggtgtgagaggttagctagattgtgtataaggagaggtaaaggtaggctagagcagtcttgggaagaggttattagaaatgaatgatacgcgtgtagcttaccgagaacaagatatggaggtcgaggattatggtagaaggtcgagtgttgtctagttcccttatcagtatgaatattattactttcctaccatcatacttttgtttgtgatttgcttactgattgaagaacatatgtgttttttctgttgaattaaaattggatttttatttaatttatcatctttctcgaaaaggttgttttggagtgaatagttggaatttcatgaatacttcgctgattttgagtatgtgttatgatattattgtaaggtataggacttgagtctcagatgggttaaatgggggctgatgtggatcgtatatagccttaggctctccctccttaatagctagcttttggggtgtggttctcccggggtagtatcaatggtatcaaaaccatctaccacccttcgttcctggcggcacctgactcgaaaagggctacctggtaaagagatacctacttgtggtagagtgaaagctacccagtgtggagttgtcgaggacgatggatgcggagagtggtggtttgttatgatcctattgcaaggtatgggacttgagtcccatatcggtgagatggggagctgatgtggagtttatagccttatacagctttgagctctcccaccttaacagctagattttgggtgtggttctccctgggttgtatcaaatcaagttgggacttctaatgctcttacttgtggaaaggattcatcagtttatgttctgatagtttatgtgacagtttctttggtcgtaaagcaaaaaaggtgaaattcttgatgttgtacatgtaataagtgctgcagtccctttcacttttaatgtgtagaagttgtgcttccaccaattttcttgatagattaaaattagttttagttgaggctccctttcttcgatcccacgtttcaggtactatgtaagttctgtgaattcaattcccatttgaaaatattggaatggtttacaacctttatagaaaaggaaaaaaaataaactcgtttcatggctcctagataaatgagataggtgaatcttctgatagtagtgtctgcatagcaagaaaattgaaatcctcattttacatatttagtaagtgctgcagttccttttgacttcaaagatgatgtgatgacgttgatattgttgccttgaggtgtggaattatgtcgcaagttatttattggagtcaattattgtacttatgtaggtattgcatgcatgctatacgaaaatgttgccttctgttgaggtggagaatcctcagctcgttgtgtggtcagactcagtagctgagttacttgagttggatcctaaagagtgaggttttaatgcttgctgaagattgtcctttctaatgtattgtgatggaagtgacactgagttcttttaacctttcagatttgagaggcctgattttccacttctgttctcaggggcatcacctttagttggagcgtaagtgtcacttttctagtttggatctgcttaaacttttagtagtccgacagcatgttaagttgaatttgcttctgcagtgtgccttatgcccagaactatggaggacatcagtttgggatgtgggctggtcagctaggtgatggtcgagcaataactcttggagaggttttgaattcaaagtctgaaagatgggagctgcagctaaagggtgcagggaagaccccatatagccgttttgctgatggtcttgcagttcttcggagtagtatccgggagttcctctgcagcgaagcaatgcatagtcttggaatcccaactacaagagcactctgtcttgtgatgacaggaaaagatgtcagcagggacatgttttacgagtatgttactccttatagtttttgtgacatttaatcagcaaggacacgtgcaatctattcactaaaattggtggagaaccacctatccacctatatagtatcttcactgtatacttggagtatgtatagggagccatgttataggattatgctcgtgaaacttgtttttttatccattcaagtctgttttttgttctttctatgcttgactatattcatattcatgcagcgggaatccaaaggatgagcctggtgccattgtctgcagagttgctgaatcctttcttcgctttggctcttaccaactacatgcctctaggggtaaagaggaccttgagattgtgcgtactttagcagattacacaattagacatcatttcccccatctagagaacatgtgtaagagcgaaagcatatcattcagcataggcgaggaagatgatacggttgtggatttaacttcaaacaaatatgcaggtaatatattggttttcttgaagtggataataggggtggattgtttatgccgttgtggaatctgttctcctttttaatgctgaattaggtgtgaccaaagagagtgatggtattgcctcttgatgagtagtcctagtcctcaacattccagttgtcagtatgactcttaatgtttttatatgcctctgttagtggtcctttatgtcctcccatgtctaagtggaaggtatatcatataatgtgttttaccagccacttctacgggcttggtagtgatttgtcaggcttctaacatccatctggtggttagtttgaggcaaacctctattgtcagaatctaaaacacttagtgtagagaaaaggaagcatttattagtgtagagaaaaggaaggaatttattgtcattaaaagattctactttttggtctccatacaatgtggttatattgattatcttgaacttgaagtggatgtatggatggattgtttatgcgctaaatgtcagtgatagtaattgcctcttctggatagtaatgtctccgtatttcctttatcagcaaagtcttaatgattttccttgaactgagggtctattggaaacagtacactctaccctcccttgtccccgcttgtgggactacactgggtatgttgttgttgttgttggaaaggaagtgctttactgtcataataaaatgctacctttggtcttagaagagagaagaatcatatgttctgatttctgtttgttagtatttttagttcatctgacaccgggaaaaatgggcttggagttttcattcttgtaatatagttctaacttcatttcattttgttctgtgctatttattgtgcatttttgttatggaactgaagaaaaaatatttttatttgcatattttgacaaattacttttctcacatgcattactatatgggtctatttgttcagcatgggcagtggaagttgcagagcagactgcttccacaattgcgaggtggcaaggtgttggtttcacacacggagtgatgaataccgataacatgagtgtgttaggcctcaccattgattatggcccttttggatttttagacgcgtttgatcccagtttcacacccaataccactgatctacctggcagaagatactgctttgcgaatcagccggatataggtttatggaatgttgctcagtttgctacttctctatctactgcacagttgctaaatgataaggaggcaaattatgccatagagaggtgacgaaaaatattaccatttgctggagcgtattctttccgttgctttatactgttgagtgacgtttcgtctatccacttttttaggtatggcatcaaatttatggatgactatcaagctatcatgaccaaaaagcttggtttggtcaagtacaataaacaaatgattggtgaactacttaagaatatggctgtcgataaagttgattacacaaacttcttccgattactatcaaacatcaaagccgatcctacaattccagataaccagttactgattcctctcaaagctgcgctattggatattggtcaggagcgcaaggaagcttggacaagctgggtgaaatcctacatacaggaggtatgtataattatcttcttttctttgaattaggagtcatcttcttctcaagctcagtcgtagactcgtagtgcatcgtaagtcatatcatctttgcaagttaagtcccatttcttaacatacataacttcatttttttgcaactgtggttgtaatttttatttttgtgttgactatgatatataattgtggtgtgaaaccatctctgtggtttacaatctgttattttgttcgaatgacaaattgtaaccacgtataaacaatataattttctgccgaagggggcttggatgaaaccttcacccttctccttctctgtaatgcaagattcttaactagtcactgttctactctacagctctctactatcggtgtatcagacgatgagaggaaggcctcgatgaattctgttaatccaaagtacatccttagaaactatttatgccaaagtgcaatagatgcagctgaacaagacgattttggggaggtcagacgactactgaaagtcatgcaacgtccatttgacgaacaacctggcatggagaagtatgcgcgtctgcctccagcttgggcttatcgtcccggtgtaggcatgctttcatgttcctcataaattctctctactatataatacaagatattaacttgtatatgcattagaaattttagcttaaaagttcttgtagtaatgtgtaaaaggtatagctattctctttttataccgccttttttttttcggagggtggggtgcgggtaaggatgggggtgggtttgtagcatttctacgcgtattttgcgtgagaaatacatttttttgcgagttccataccaatataaattcaattagcttgtttgttttgagcattgatcaatcatttcctcttgaaatgcatcgagtaagaaactgtgtatcgatagaaagatagagcgatagagtcgcaaccatgatgatccacttatagatgcttaatatcttattcgcaaaggtagatatgcattgtgcagaggcgaattcacaatctgaatatagtggtgattgattatcgtactcaaaaaattgttcgatctccttacactctctctctatttatttattttcaaacttcttttcgtgcctattttagtgtgtggttgttataaacttatatcgatatttgacgtttagattttatttagttgttacatgcaaacacgtcatttcacaaaatgcgtgcaatataataataaaagaattttgatacatcccaataattaaacgtttcacaattaggaaaccaaatttattattgtaacctcgattttccaacaaattgagattttttatttcgattattaataccgctaccatatataacagagctttacacgtaatagtatatgctcgtaacaatatatctagtataattttataagtgaaatttaaaaaagatagaatatacgcaaacgaaaaaaaatcaaagcataatttatttagtgaaaaatttataattgacatacattgtatcggaagtaaaatcatagttaaagttttattaaaacaaataagatttaagatactcaaataggtaatataataattttaattaatgattagaatgatttataggatctttttttttttttgcatataagaataaaatattcatcgtagttatatttcaaaatatttttaaaaaaatatgtttcttaaaaaatatttaaaagttaaatcgatcgatttgcccttctatttcagtttcctctatttaccttaagcatttttttccgtttctatatgtttatcttatgatatttatcttacttatgatagattgcaatattcttttgtcgttgtttaacacactcattgatatttttaattgaataat

SEQ ID NO: 394 - DNA, 6520 bp, Solanum lycopersicum; identical to SEQ ID NO: 254
  modified_base (5739)..(6396): a, c, t, g, unknown or other

SEQ ID NO: 395 - DNA, 2410 bp, Solanum lycopersicum
aatttaaatatgtttatccatgtgatttatgaaaattttactataaattatcctatttatatatttgacgaataaaatatataaataaaattttgaaaaagaaattcaaaatacataagcttactttgcgagtgaagtatacaaacacataaaaatatacacattacagtctctatcacggtcactataacaaatgaaatgataattatgaagcacaattatcaaatttataattatgaaattttcttaaagatgttatttccgaatttttttcaataaaaaatctctcaattttacataaatgccaaataaatttaatagaaaacaaatgcgtcattcttagacccattcaagttttcgattctcctaattttacttacttcctttatttttatacatccatttaaattttctatatttttatgtattacttgttttataaagaactatttattttaatttggtatagaagttaaaaaataaatataatcatgcagtcttaaattaaaattatgtaaaaatatataaaattattttttaattttatgaacttaaatatgcaatgtgaaaaattgttacaacaaaaaagtcattcttttttaagacagactaaaaaataaaggagatttcttttttaaattaagggaataataattattaatttaaaaaataaataattaatgtgaaaaagtactaattattttctgtacattaagcataataagtaaaataatatttttaaaaaaagtaaacagataaaaataaataatactagtagtaaattaagagtcgggcaattaaacaaatggagtaaggacaaagaatgccgcgcttcaactctctgtctttttctaagaaatcacagtgaatgaaacgtcttgaaaaccactggctgtaaagcccacagttacccaaaaaccagcggcttatcactttctagctaatctctttatccaatttactctttcactgcctatatattcagcccttattttagctctgaatttcaatcatcaccacaatcagagaagcaaagaagaaaaacagagataaattttagaaggaaaataaatcagaatgagttcaagcagaagagcgtggatagtagcagccagtgttggagcagtagaggccttaaaagatcaagttggattgtgtagatggaattacccattgaggtctttggcacaacacacaaagaataacgtgagatcttattctcaagctaagaaactttcttcttcaataactacaaagagtgagaagatggagaaatctgaagaatcattgagaaaagttatgtatttgagctgttggggtccaaattgattgtaattaaataggattactctgtatttcgaaaattatatcagaaaactgcaatacattgtgttgatatatttcgatgaacttgttcctcttatgacaaattacatcacatccaccatgcttttaggaaataaatctaaatctgaaaatattatattccatgaattaaagtaaaagtcgctcctattgattttgatgtaaaaaattaagatcgaaccgcatctcataagatcacaatggcgaagatcgagtgaaggatgaaaaagttaactatgatttatcctatacccaagcaaaaatcttaagtgtatatcaaaaaagaattgaaaaatcaattagaaagatacgatatcacgtaaatttaacgaaaaactatattgaatcgatactctttagtaaataatcactcatacttatataaaataagtgtattaaaatgtgattaatatattaataaaatttatattatatttaaataatagatttttaaaaaatatatattaaaattatattataaatatattaaaagtttccctaaatttaacttcgtgaaagatatattttaaatagttagaatgataagaagactgtggatgaaattagtaaattcattaagttttctcttgtctttgtttttttgggtaaaattaagcttacttggagtttgaaagatgtttgtcatagtataatttctacatacagttactttgtgtttattatattttaattctcaacgtactttattatcgttattaaatttttttcttttttaaaattgtcatgtacagtttccttcttaatcgaaacactttttcactattttatatatatagagagagagaatattttaaggttgttgatttgagtggataactttttgaaatcagtgataaaaataaagcaaaatgtgtgatgttcattgaatatcctttcccatggtttgggcgctggtggattttctttaatcttgccaatccgtgtgcattcttataaaagaaattttattttagcctcatgtataccacaacacgtgtcactcaaaaaaacagtgtgctctccaaatatagtacacgtagtaata

SEQ ID NO: 396 - DNA, 3506 bp, Solanum lycopersicum
ttgatattgagcaagttttccttactaataatttgttgtgattatcataattttggtcacaagaaattctgacaaattgtcataattttagtcacaagatgtgccttaacaagttatggtaatgttagaatttagttagaaatatttttaaattatggcagaaatcttaaattatcataagttgtccagtgaaatttttagaaaaaaaactttatgctttaaaattatgctcagttaggtttttaggagcagggttgggacaaattattagcgaacaacaaatattgaattttgcatatctttaaagggtattttaacctttttttctcttattttaagtgatgataattttgatacttgtacaaatttggctaaatctcagaagttttgtacaatttcttaatcttcgcatccttataatcacttatatgtaaaaaatttgaggtaaagtaatttgtaacaaacatcaatttggaatttccaattgtacgtacgtgttaaaccccaaaaggtgaaaactttctaatgaagaaacaatctgagagacgtacatttgcaactgggaaatcaatttccaacgaaaggaaagaatcactttttatgcgacactattaagttatcagtataatagaagtttagtgcttttgaactatttttttattcatttgacgagctctaaaagtttcatcaatttcaacaaatatctgtcatatatgatgatgtgtacacccaaaatctgcttggtccaggtgtcaagatgctacagcttgtaaagtaacccgaatccaacatgtcaacaattaatgcattgattggctgatggaatatccaaaaccagataaggtgatcctaagtgtaatcactctgcatcacaggcaccagaaattgcaatatccaaatcatacgtaccacaaacattaacttataattcccaaacatttgtaatcaagtcttacctgaaacattttattttatcaccaaaacaaaaaggtcctgaggaatggctcatgctatggcttctatgggtggcctaattggttcttcacaaactgtcttggatggtagcctccagcttagtggctcagcccgcttgagtactgttagcaccaacagaattgccttgtctagaccaggactcactgtcagagcccaacaggggtctgttgacatcgaaactagccgtagagccatgattggtcttgttgctgctggcctagctggttccgttgctaaagcagcttttgctgaagccaggtcaattaaggttggccccccacctcctccctcgggtggattgcgtaagtcgtccttttgctttctttcctgctgatgaatcaatttccttcttttatagacatagatttataaattctgaattacacgcgcctagtctagattcatcactgattaatcgaacgatacaatagtaatatcataacagatatatttgcggacaattgatatagtgtaagattcagatatgcaagacagagaacctaggagtgaccctccaatgctgcatttcaatttttagtagtttgaacctttagatcaagcaagttgatatttatatcagcatttccaattgaaagatagatcaaggaatagattgatttagatttgttattagatcatgtcaaacagaaaggtctttaagtaaattaaaagagagaattaaacttgagaaagacaaaaaaaatgaggggctcatatgaagtagttaaagattgcattttgacaagatgatttcaatcccttctaattttaatagtaatattgtgtgaggggagcctagccgtagctggtaaagttgttcgagttgttgtggtaatagcctcttgcaggaatgcaagatttagaagtagttatatacatgcagttggaactatcatgatttctcattttggtaaaattagatgtacagaaaattccaacaatttgaactagaaaggataatgtatggaatttccgtactgatgctgaaatttggtttgggcagctggaactttgaactcagatgaggcaagggacttcagtttgccattgaagaataggttttaccttcaaccgttgactccagctgaggcagcccagagagttaaggattcagccaaggagattgttagtgtcaaggatttcatcgacaagaaggcctggccttacgtccagaatgaccttcgtctcagagcagaataccttcgctatgaccttaagactgttatctctgctatgccaaaagaacagaagggaaaactccaggatctgtctggaaagctctttaagaccattagtgatgtaagtcaaatgtctaaattcttggttaataacatgaatgacatagtaattggatgggttgcttatgatttcgcttttttctgacaaaagatttctcattttctttcctcagctggaccatgcagcaaagaccaagaacagtgctgaagcacagaagtactatgctgaaactgtaactaccttaaatgatgttttggccaacctgggctagaaaatttttctctactatgttattacttcctgtaagttaacgaatacttcttgaatcaattgtgaagaatgattttggaagaattgtttaaaatctgaaacaactagtgctgcatccgagagcctcaacttgagttctgcatgtgattttgattgggaatttcacttgattgaggcctgcaaatgataaacatggttgcaccattccagattactgaatgtgttgcttaatctttaatttgtttcacataaaaatctacctcaatcatgaagtttcactacatcttctgtcttaagtcttctggcttgcaacaccagagctacatgaccaaacctaaccctccaaatctacatagtcgtcctacttgactcaaatttaagtactttgaatgttaagtatcgtgttagcatgcagaggaatagattagtaacagcaaggatgctaattggaaaagaagcagtgaaatcatattcagattaagccccaaagtagttgcaaaaattacattgaatactgaactagtataagttttgagtcagaccaacaatgcttttaatacattctctcttcttttgggaaaacaacacagctcacgttactgtttgctcaggacatatattatgaacatcaaattacactagggtcaagaaaaagttacaaataacataaaaattcaagaaatgttacatgaaatattaggaattttttaaagggaaatatgggactcggttatgatgagttctccatacatgctctgctttcatttctcccgtagagagcactgagttgatttaattctgttagcgaaggctgcatatattggaagagagtaacttttttttgtattcatgcatgacctccttgttgattcagcttcttatcttcctggatggtggctgtagcagagatgtagtaggaaactgagaaaagtccatggataaagcacaatatccctcctattgacaagaaacgatggtgtgatatgccacaagatcttctt

SEQ ID NO: 397 - DNA, 6489 bp, Solanum lycopersicum
tactcagaaagagcttcagtaatagtattaacccaagctttagcattactctttctatccaattttttcttaatattcttaatgggcgttctcttattgtttttaaaaccagattgttcagtgaatcctgggtattccccttgtttccagtgctttttcttcggaaatgcaactgaagaagaagcacggcaacatattacggcgatgagtggccgccggaagtcgaaaagacgacgaatgttaccgccggcgggatgaattagaggagagagaaagagtgaagatgaagaagataaagaaatagaattggtcgccattttcttctcaattaaacattcaatttctttttcaaatatatcatgatatatatatatatatatataatattataaaaaaattaattttattttggtccgtatttgatatctatatcaagatcctaattaattcgactttgaatttgaatgcttaaaaaaatataaaggaagaaacaactctaatacgattatattcatactcgaactcaagatgtgtgttcttatttgtattaattgtaaatttgtgttttagttcaatttttttttacttgtttttttgttataaattttattttttaaaatttatttttacttgttgaaaactttatatataaactaagtcattctatttacttattcaaaaatacttattttcttctaatatctaaaataagatacttttaacaataaactaatgttattccattctatatgtacagaaaacagtgtgtacacacactttttatcattcatatcaatgcatgtgtatagaaacagcaagtcaaggcttaaagggtggatgacagagacgcaacaactaagcttacactattttctttttctattcgtttcaattttacttgtcatgttttattttttttaaaaaaaaattatataatatattttttaaattagttaatttgactatagagaactgaaatgtactgagggaatactatttatgactaataaaacctataataaatattcacttttgtctttgcgtattgatttgagttttttgattattctctttccttttgttgctctttcagttcacagatcaaaaccccccacactttcaagaaggttagaatcttgtaagaacttctaattttaaagcccctttttactttttttttttgtgaaatttggggttgttgagttgattttctgcaattttgtgtctatataaatcatggggttgttataatttttcagttttgtggaaaaaaatggaaccccagttgaaaagattgttcctttttcagttacaagtttcaagaaaagaaaaagattgtttttttttgtttttttcaagattatttgctgggattacacttcccgtttttttgttgtgagatttttttagagtatgttggatgttataatgtttcttgcttttacagaatgtcacttcttttcttttttttgatgtcattagcttatactgcacagcttgttgtggatcagtaagtatctggaaatgtgtggtggttgttatactgctgattagtggtggtgtttccttgttttgagacaatttttgtgatttttggactgtttgagttgttgtattttgtagattttgttgactgagctatgagctgcttcagttgttgtgatgatgatgatatgcacagagctactgataatgggccattcatggcacacaattcagcaggttagttttgtccttatatcgagaatctcttccgattgttttcttaacgttttctggggaatgagtccaactgtagacaattgatatagctaactagtttgtcgttgaggcatagcagtaatagttgttagttttgggtaagggaaaggttatggtagtggaatttgatttcaggacttctacacttatggtgaatacttgagcattctgggtatctattgtgattctttttttcgtgttgcggggaatggatccaaatagagcggaatgaatatagacgattgatacagctaaacaaactaatttatggttgaggcacagtagtaattgttgtctagttttgggtatggaaaaggataggggagtggattcctaactggggtatcagtaaattggaagctcgaacatttattatgcttgtatttgatgttttcgtggtcagttccggttgaagccttgtaaattgataaatgatcaagtaaaaagattgctttggtgttttacctatcattttagactctttcttcatctaatgtcatgcttttgttcatggaacttttgtttagtccataattttttatttcaatcctacctaactggagaacttttttataggcaacaatggaggtcagcgtgccacagaaagtgcacaaagagagacacagactgtgaatatccagcccattgctgttccttccatcgctgttgatgagttaaaggatatcactgataactttggttcgaaagctttgataggtgagggatcatatggaagggtataccatggtgtcctgaaaagtggacgtgctgcagccattaaaaaattagactcaagtaagcagcctgatcgagaatttttagctcaggttagctacaccctattatctttcatttgactatgttatattgcactcaacctttgtaaccttgttgcatatgatgcatgcaattgcaggtctcaatggtctcaagactaaaagatgaaaatgtggttgaattactcggttattgtgtggatggcggttttcgtgtgctagcctatgagtatgccccgaatggatctcttcatgacattcttcatggtatgtgaactatgctattgtccgtactggaaccatgttttaatcctaccttctcatcagcactaaaacatgttgagtcatccatgatgagtcaaattttagcaaatctaaagaactcgtctctgtaacttgtgtttggaaattattgttattcaatccaactatgtcaaagtacatttcagactccattttaagaacttcattaatgcaccttgcagtgaatgcgccctttagtagtggttaacactgcttcatcccaaattctgaagttcgtttctaatgcattctctgacatgaaaagtgccataaatgatagttagtttgcacctagatatcttcagacagccttgcttattaagaaccatcaaattctttttcttcttttcgctttttgttgtatatgattccattgtaaaatataccccatctcaattctcatttaacatggaaacactcaaaattaagagatcagttagatttcatattctgttgatgatatataaaaaaaagtatttgaagttgttaagaggaaaagtatgtgtaattgctttaaattcaaccggtaaatcggattgatcaaagtccaaagttgtgtatagaatgctatgacttgtagatttgtgctatacattggggcctcacagaattgaatgtatatgctaagttaggataaagtatactcggtacacaaagttagaatattgcaccacaaggtatgtattccaatgatgtatgtgcacacaaaaaatcccatcaggtacttcggtaccagatttcaattatagatggtgacgttggtgttatgcaaagggaaaaatttatttattagtaattagcatgttgtatgtcagttgaacattcagtgaaccagggttttatttaggtccttattcatttcatctgtattttgctgtttctgatatttttatggatgtctattttcgtctgtatgtatggccaatttgatagaagagaattggaacttctcattgatatctctgtgcatggccaatcacgttttctttacaagattttttttacaactcttgatggtggtagtctcaacaagtaaatgtgttaatgtgtatcatggctactgctaaaacatcgttatgggtgcgtattatgaggatggatagagataatgtcaatcttagagtgcttggactgatgttacctttctcaaaaaaaaaaaaaaagagtgcttggactgggaattatacttttggctgctctcttcagtttttctgtaacatattttgttattgcagcaaaatgcataattttctagtttgtgattgcaggaaggaaaggcgtgaaaggtgcacagccaggtccagtattgtcatgggctcaacgagttaaaattgcggttggggctgcaaaaggactggagtacttgcatgaaaaagcacagcctcatatcattcaccgtgatattaagtctagcaacattttactctttgatgacgatgttgctaagatcgcagattttgatttatcaaatcaagcccctgatatggcagcacgtcttcattccacccgtgttcttgggacctttggttatcatgcaccagagtgagtctctctgtgaatgtataatacaaataagcacatgcttggttaacatattcttagctgatcttccccacgactaatctaatatgcaacagaaagcaatgttaggctttaagctcatatttctgaagtcatacccaattatatttcacttttattctgatgacctaccccaccatcacttttgagttgcagatatgcaatgactggtcagttgagttcaaagagtgacgtttatagctttggcgttgtgctcctggaactacttactggccgtaaacctgttgatcatacattgccacgtgggcaacagagtcttgttacttgggtatagccttctagattctcaaatgcttcatctaattcaccattgttcaataattctcttgattggtcatcgatgttattcactgttgtaaacaggcaacgccaagacttagtgaagataaagtgaagcagtgtgttgatgctagattaaatacagattaccctccaaaggcaattgcaaaggtatgcactcaaaacggagaattttcttgcctaatgaaataagattcctgtctcgtctcctcaactatgttaattagtaaccaaaaagacgtccgaacaagtgtaaagatcaaatgtttcattatattcaatcgtttccgcttatctgccttactgaaacagatggctgcagttgctgccttgtgtgtgcaatatgaagctgacttccggccaaacatgagcattgtcgtaaaggctcttcagcctctgttgcctcgacctgtaccaagttagacatcaagcttgtgaattttctccttacccctgcctttacgtcatgaaatgagaaagattgatatcgacattgaaattggtatgagtcacaagaggatcgtgaatttgtgatactgatagtcacctggacaactactccacaacaatgttacctccaccccccccccccctttttttttttcttcttgttgattgaatgccaaagaaattgtatattcactgtaatggaaattactttgcagattgattttcatggatttgtgttgagattttgacattctaccaagccacagttatattagtagattgttgaagttgtagtttttgttgttactgctttcacttctgtattccctttctcaaattgtagcttttgtatcaaaaacatctttatctctacgagttaagggtaagggttaactgacttaacccgtagagatatagacttaagtctgtgtatgctctatcttttccaagagtacaacacgtgatgtgtggattagacagacgtgtggattagacagacgaccacttttagacacactttcaaactctgtcgcaaacaaaaacatagtatttaagagggacaaatacattgtttatcgagtttagaaccatgcaccactaaattttccataagcactggtttttctgcaacaattctggaacattcatcaagtgctgaagttatcacagcccaagaaaatagaacaaaaactagtggtttttttcatagacaatcacaaatgaaaccttttacatatcttttgctaaaagggcatgtgaagttgtcaactatctatacattacccatatctgtaaagaacacagagtcaaaaatgaggaacttttatatactaagtgactctgactttcatacacacaaaaaatgattatctcaaacatctactaccatattataagacataccaaatggaagaaatatatatatatgtatgtatatatggctcttttttgtgccatttcaatcatttcagctcactgtaactttctgtagttcaagcttatgcatttgttcgatgatcgcttctagttttcgtcattaaaattggtctatcactgctatctgtagattttcgattatgagattctgtttctacagcacctgcctgattctttctccgtcttcgtccctagaagaccaagaagttaagattatacacaactttccaaccaaatgtctaagaaaattgttggttagtacatcacctctcggggtattggatattcctcagattcaagcattcgaactacttgactcattgttggcctcttatctgaatctggatcaagacatcttaaa

SEQ ID NO: 398 - DNA, 7221 bp, Solanum lycopersicum
cataataaataatactagacggagggagttataggtacacacagattacatatattttttgggaaaaagaaaaatatacctctgaatcatcgtaaatgatatgtagacacccctgtcatcatttaagaacattggtgtccctgccgtccaaatactaatacatatatacctttcactgttcttatccgtcgattcgatatttactaaatgtcggatcggtggataagattgtatatgccctttagtaaaaagggtatatatactctagtttttgaacgacatgtacaccaatatctctaaaatatgacgaaatgcatctacaaaccatttaccatcatttggagatatataattttcgtccttccaaaataatacatcttttacttttactactataataatagacgaaatataaaataaataaacggataagggcctaaaatatccttgaattattaaaattggtacaaaattaccttccatccaactattagtcctgaaatgtcctacctttaggttctatattgccctttatttttaactatcccaatttaaatccaattaataaattcattagtgacgtggcaatttattttaattcactaaaaagagactaaaaagctaaataagtaaccgtgtaatttaagtactaaaacgaattttcgtgcctattcagattggatttgatatatttcctcttttttttaagaaaatcaaatttattagtggcacaagtttgtcgtagtcataattacccccgtgaaaacattaaaaaatcttgaagggtattatggggaatcttcaaaaaggtacctttttagttttcatttgtgtaagttagttatataaaaaaataaactgtttatacaaaacgccaaaaaaataaaaaaaatatcagacacaactatataataataaagtataatacagtgaactgataaattaataaaagggataaaaaattgttcatatcagattcacattcttcttttaactctgcttcaaatctattgatttttccaatgaattgccttcagaatcttcccaggtatatatatatatattattttttgtttgaatttaattagtctcatacagaaatgcagagtaagattgcgtacaatagatcgttgtggttggagccttatttttttgttaaattaatttagtttatttttggttttcagatcctctggtttaccactgagaagtttcacaggcaactcaagaaagctttattccactgttgtttcactggtaattttcatttattgataattagatttgattggaaatgtttgatttgatttttgtattgtattagtgtaaattggaagaaaaattatataggggtatatatatgtctccattttggtagaaattggctataccaaatcaaattactcggtacttgtgctggtgggaggtagcggggaggtagctgtagaattagtcgagatgtgtgtaagttgattggataccacgtttggtagaaattggctataccaaatcaaattactcggtacttgtgctggtgggaggtagcagtacctgttgaattagtcaaggtgtgtgtaagttgtttagataccatgtttggtagaaatggctataccaaatcgaattacttggtacttgtattggtgggaggtagctgtagaattagtcgacgtgtgtaagttgtttggataccacgtttggtagaaattgtggtataccatatcaaatgactcgatacttgtgctggtgggaggtagcaggtaggtagctgtggaattagtcgaggtgtgtgaaagttggtctggataccatatttggtagaaattggatatactaaatcaaattactttctttaagattggacagagttacttgatgtttgtgttggtgggaggtaggaggttatatataccttgtggaattagtcgagtggcgtataagctagcctcggacactacagttataggaaaaagttacttcgggaccgtgttttattggggttgtggagaaagttttagcaatttttcctttggcttttctcgctacttggagcttatggttttgtttctataaaagtgtagctctttcttctcatttaactacacgagaagctaaagaagcagagaaacaagtcacggctgtgcgtgaaaaatcgagagtgtgagggtgctatggtaagttgtgtaaataaaaaaagctatcttttttattttctacaaacgtggtgttccagtcagcttgggggttaccatataattctgtcgtccatcgattcttggacagatggagggaatcacctaatgtttttgccttcgctggtatttgaaccgaaaacctcatagttctcaaaccatttcattgaccagtagtccacacccttcggtgcaaaagtagggctatttcttgtggtgtattttactcaacgcttcgaagtggtttaagatattacttaatacttttcaatgttgttgttgtatcatgctcatttcttttttgttcacaggggatgacaaaatttgctgatcagcgtctaagtattgtggcacaggtaatatttgaaacaacgatctatgattagattatttgaagaattgtggaaactgctgaattgttttacctattcacgagaaggcgaagcgttgctttttgatttcagccattaacacgtctttttgaagcgacagtctccaagatttttgctgtctcatctaaaagtttctatgagatgaatgtatagatttgaactcaatctgacatttcattgctttcacatcttaaaactaatttttcaagtcctaatatagccggaaatggcgaaaaaattggaacttgatttctgcaccttattgaaattaagtatgttatactccctcagtcccaatctacgtgaaggtgttagtatagaggagtcgaatagtttttttcctgtgataacaattttctcaaacatcaactttattgacttgtagtacttcttgtgtagttttcagaaaatgttaattaatccatttctgaatcggcattcgcttacttgctctctctctaggttgtatctggtccagaatctactacagagaaggatgaggaaaaatccgatacatacagtcatgacatgactgcagctatgggagctggtaagtctatcttcctacatgtttttttttagttctataaacttcatgttctttaactttgaggagttgtctggtgcatacttctccgacccgacttattaaagaaaacgtattacataactacattacatgtttgctaataggttaagttatgtgttatcgttttctactatttactcttctttgtttctccttcttgcctaccccgttgttgaagaacatccttttcttatgcaaactgcaaatccaagtttgctctatgttgacatgattcagttatattagcgtaactcttggattatgacatgcacttttagtcattaactaatcaagaaatgtttgcacagtccgattgactaactaatatgtgtggcactgatatcgtcgctgactttcttaatgcagtcttgacttataggcatgagttaggaatgaactacaacttcatccgtccagatttgattgttgggtcatgtctacaggtaatgtgtaattcgttttctttaaacatattatacttttcacttctttttattgactccaacgaattatgacagactcctgaggacgtggacaagcttcggagcattggagtaaaaactatattttgcttgcaacaaaatccagatcttgagtatccatgaaatatgtcaagattatttgtttcatgtcggattaacaaattcattttaagtccttaattagtattttctagatactttggggttgatatcaatgctattcgtgaatacgccaacaaatgtggtgctattgaacacttgcgtgccgaaataaggttagttcaagagaaaaaaggtcagcagtgactgtatctctatctcagtgattggcgcttgcaagtgaatcgttgtgcatacaagttccgaaaattgataagcatcttgcttttgtggctctataaaatttacatataatttctacaatgtgtgatgcataaggcatttcgaaaatttaattcgatgaagctaatgaaccagggattttgatgcatttgatttgaggttgcggcttccagctgtaataagcatattgaacaaagccatcaatagaaatggaggtgtgacttacatacactgcacagctggacttggcagagctcccgcagttgcggtatgtgcttatgagtttctttatgttgtctgacggagaaggttgctataactctagcatagttatgattgaacttacgttctatttggtactttgaattgcagttgacgtatatgttctgggttcaaggctataagcttagtgaagctttcgatttactcatggtaatttttccctgtaatgttgtttatctagtttcactttttgaaaatgttattattgccggatgacttgctataccacaagtgttctttgagaatatcgtgaataatcgtccttgaggaagaagagtttgtctttttgggtccagtagacagtagctaaacttattctatgtttatattttgtttttcaactcgaactggattttgcgtatcttgaccatatcttcttgcagagcaaacgctcctgttttccgaaactagatgccatcaaaagtgccacagcagacattgtgagttctattgttgttttaacaatttatcattcccgtatttaccttatggcttttggtgttggcgtgggatgcgtggtaatatatactgcacttcatcatttgataaagtgaatttgaaatttgacggagtatcttcctgtttaaagcttacaggccttaaaaaaatgcccgtaacgttaacatggcatggtgataattgtactacagtggaaatatctggacttgatattggttggggtcaggtaatattcaagtctcacaatggttctccattagttattttcttcagaacgttttacggttttttcagctgaccatagtatactttgttcatcattttcaaatttcgactgtcaacttcagttcagcactaggatatactgctataggtagaattggtctatgacaatcacacttcctgtcttcgatctcgtaagagctcttactacttggaacagtacattctggaataagaacaacggttcctattattgtagcgtttcgttgccttttacatggttcatgaaatactcttctcacgtcgatgcaattctgcttatttcatgcttaatattagagcttatttaagaacgttataatgttttccagagaatacctttaaagtttgacgaggaacgaggtttgtggactctccagaaggatttgcatgtaagtatgttgttttaggcttgcaattgcttcgtccttcttctttcaatgatggaaattgtcgagaagctagtaaagttgttgccttgtgaccaagagttcggaaacagtctcttgcataaatgcagggtaaggctaattgcgttaaaggatgttatcctaatgtcgtctttatttacaggaaggaaaatatgaatacaagtacattgtagacggtgaatggatatgcaacgagtttgagccgatcacttctcccaacaaagatggacatgtcaacaactatgtagaggtaagaaactgacttttcgtgtgatttagagagaaaggttctatggcttcctctgtttcgtcctagatatgccttcttctgtacattaacgcgaatcactgaccatatacatatgctgcaacgatgaggacgtttagcctttatgcctaacttttaccctgaccgttgaatctagagtaacgattctttggcttcacggttatcatctcttacctctaacgttcaacttggacgtgccaacaggttcttgacgaaaatccagacaacatcactagtgcagcagtacgaaagaggctcaccggtgatgaccctgatcttacctcagatgaaaggctcataattgaacgatttcttgaagctcatgcagacgtagaatgaaggaatacttattacttactagatacacttaataattgtaagcaaagtcaatatctgctatataactcatccagttgtaattagtatgcagttttacttgaatgaacactagttatatcatatatgttgtagtgaagtaataacatccttaatcttctttttttttttgtcttttggtttctacttctgattaaattcgaattcgcgtgtgaaaaagttgcacactttccataactaaggtaaccttattctcgaagctcgaatctaagactggtctggtactagtatttgtctatatgtagtagtgaagtaataacatacataatcttcttcttcttcttcttctttttttatgtgttttgtgtttctacatctgaccaaatccatatttgcgtgtgaaaagtaagacacgttccttaactaaggtaactgttttcagagctcgaacctaagactgatcttgttaaagataaacgagtactagtaccctctaccacaatgtttggtcttcaaagcccaccattgttctatatcttgagaaaacgtaaaatatttggcctctgttactttttatttgtccattttggacttgcacgttgtaagaaagaattattaatatgaatattttactataatattcatattgattgatacatagttttagatcttggaaaaacaagtaatgttgaccatagtcacggtacaatagaaataatatattttttgatatattaaaataacaagtaaaaataaaatactttttaatagagaaagaaaattaagagtggtcgaatcaaagcattaatgtgtaagcacaagtgtcacaattagattcctaatcacatgattaagcattaattaggcgtgtcggtgatttttatctgttttgttattataaaaataatattcaaaattaatagtgttaaaattgtaaaataatgataacaataaacagtaaattctcaattgagagttaaaatcttgtatttgaaaaagtagtaatatatagataaattttaaaagaaatttattccttaaaatattatataaaaaaaaactttgtactccattaaattaaaccaagatagatctagaatttcatcgatatatcaatgtgaatccaatgatattttatagatcttaaatatgtattaagaattttt

SEQ ID NO: 399 - DNA, 11926 bp, Solanum lycopersicum; identical to SEQ ID NO: 259

SEQ ID NO: 400 - DNA, 3350 bp, Solanum lycopersicum
tttctaatttgatggtcttttgaactaatcatttttgacaaattaaaaataatttttgtaatataatagataaataaaaacaaatggatactatattatatttgtggcaagtggtgaagacttctccgttgacttgatgtgagacacaaagtgagtgctggatgcctggatccacacggtatgatatttggtgaatgcgagtctatcctatttttttcatatcaaagtgtgcgattattttatttaaaagtttaaatcatatcatgtgtcattattataatatgataagtattattttatttttaatcataatttttgaatttggacaaagagtcgctttttttgggaccatttttaccattaatatgatgtggaattttcaacctagtgctaatttaaagttaattgggaataaatatgaatacgtatattgcactcgtgatcttaacattttgaaactgtctctcactgacacgacaaataatacttgagtgagacataccttaaaaaaattgaattattcaaaattctagacaaattttattttcaccaaacaaaattatatataaacataggtttattttgtaaaatgtgtatcctcttttaggagcggtactgctgcaccattatattatgccaagattctaagatccaaattgttggtatacacatctaatacaataatatatattgcgtagtaattaattagtttagtttctatatagaaactttaattgaaacttcctagacaagcaaagactagtacagtgcaattcagaagtcaataataatcttgaaaaataaaataaagaatacatacttagaacatcaaatttccatcaataaatctaaacaaccaatcaatcaagactatttttccaaaacccttgggtccagttgttgacttaaaagttggttaatttcaaccgttattcattaaatacgatagaatttctcatctaggccactatataaacgccttgctactgaagacattaaatgcaagcttcttacaacaatattcttttcccttctacactaaccatggctatgaaagttgatttgatgaatattttaattacactattctttgtaattagcatgttcaacactcaaacaagaggtcgcagccagccaaaactgtccgtgtctgagagacacgagctgtggatgtcacgtcatggacgcgtttacaaggacgaagtagaaaaaggagaacgattcatgattttcaaagaaaacatgaaattcattgagtcggtcaataaggcagggaatctgtcttacaagttagggatgaatgaatttgcagatattacttcacaagagtttttggctaaatttactggattaaacatacctaattcatatctttcaccttctccaatgtcatcaacggaatttaaaaaaattaatgatcttagcgatgattacatgccgtctaacttggactggagagagtctggggctgtcactcaagtgaaacatcaaggtcgatgtggtaagatagaacactgtctcatgaaatattattcactgatattaattaattaggtattttttttgtattattaggatgttgctgggcgttttctgcagttggatcactagaaggagcctacaaaattgcaacaggcaacttgatggaattctctgaacaggaacttctcgattgcaccaccaacaattatggctgcaacggaggttttatgacgaatgcattcgattttatcatagaaaatggtggaatttcaagggaatcagattatgaatacctaggtcaacagtacacatgcagaagccaagagaaaacagcagcagtgcaaataagtagttatcaagtcgtgcctgaaggtgaaacatcactattacaagccgtaactaaacagccagtgtccattggaatagctgctagccaagatttacagttttacgcgggaggaacttatgacggaaactgtgccgatcgaattaaccatgctgtaacagcgataggatatggaactgatgaggaaggtcagaaatattggttgttgaagaattcatggggaacaagttggggtgagaatgggtatatgaaaattataagagattctggggatccttcaggtctttgtgatatcgcaaagatgtcttcttatccaaacatagcgtagcatagataagcaagcatttcttatatgttgttgtattattaagaattgaggggaaaaaatattgattgtgtacatgcaaaagctttttgcatgaagtatttgtatctttgtattaaatggaactttatgaagttgttaaaaagtgtattgattattatcatatgacgaagaaaaaagagtaattttgtgttttagtttgatatccacttaatacttaaaatattatatcacttactttcgcacttattacctaatattgacttattcttagtgaaataatttacggccacataatatttataattttttttaaactagaaattttataaatatttcttttttaacaaaaactttgtgtcaagtcaaattaagtcatataaattgaaacggaggagcgtgtattttaattttagttgaagctagactgttggaattttatgtaaatattaggagtacctcatctatatgttttcactaattaaatatcccgtagctttaatttggtgaacaaatgcctacctaattgccacaaaaagcccataaaagggatctccatccaaaatgtcaacatgtgatgtgaatacaaattttacaatttttgcacctagcttacaagttcaaaataaattctcttcaaagctatatcccatatcaaataaaattcttagaacgttttcctctatcgccctcaaaaggtggctaagtgttgggatcaacaagtaagtttctttacgaattaacacgttcctcttactatgtctttcatttttcttaactaacatttggaactcattaattcaattaattttaactctatactctataaggttcgtttaacaataaagtgttctacttcaagtttagttattcttaaattcaaatcaatatttagttaaatatgaatcaaaatcactcatttcactatatttagagctgtcaatatgggattgacctacaaggccgattcaacctaacccttgaactaaatagagttgaatttaatttttttcagctcatttaggaatgaaactttttagcccaacctcatttggctcgttagcctcgtagatcccaatatgcagcccgcttcggactggataggacttctatgctaactcgttcaactctctagctctttaaatttggattgggcccattttaaccactataaatatagggaaaattgtacataat

SEQ ID NO: 401 - DNA, 8296 bp, Solanum lycopersicum
ttcatatagatatttaattataatttactttagatgatcaactcaatacatgctaaaatactttttagctattagatatttttaattcatattttatattttgtgctcgacctattctatagataatttatcatatttttaagtccgctaattaaattatatatattaaaattaattgaaatataaatattatttatttttctaatataagttattttttattttttattttcatcgagatctatcaaaagcaacattcttaattcaaaataattgatatattttattgattatcttaaaatgtcacatgtaaaatagaactatttatattattattattattattactaagttttggttaagggtagttgatattaatgtattttgccatttataaaaaaaagcaagaagatataaattactttttaataaaatttgaaaaaagtgtcaaaagttgacaggagtcaaagatagcgcgaagccgttttagagttttaaggttacgggcagacgggcaaagcaccgttcgggcagcttaacacgcccaaaaagagaagataataatttctctcacttacttttttttttctctctctgcgcacacacaattcagtagagagagaaagagaagcagtacaaaaatgtgaaaagttgcagcagataaaaaaaaaagaaaaagaaaaggggttcatcagaagaaggagaagagttaaactgaactgagaaatacaaaaaagggttgttctgtgaagagtaaaaggggtagcaaaatcttggaaaataagtgtaaaaatttgatctttttttgttgggttatgagatgagatcgattcttgggttttgagctttgtgggggtgtttatcttggttcatggtaatgaagggtagggttttcttgaatttttgggtaaatgctgggttttttgagtttgctttacttggatctacgagattgttagtcagctggctgcttgatttctaaaaaaaaaacagtattttgatggtgaaggtgatggagaaggatactgtggtggtatcactggtggtatggctaatcttggttgtatatcatcttaagctcatttatgctaatatggaaggtttgtgggcccatcatcctcatttagttaattttaggtctatatttgatgttctattttgtgagatgagtttcaaatgtcgaaacttttcgtactagaaataaaatatatgctaaaagtgaaattggtatgtgcaaaattggattttgaatttgactaatgtgtgagttgttgaattttcccaaaagggtaagcaagatgtacaatgagttccctgcactgttacagtgacaagcagtttagttttaatgtcagttaaatgtgaaagtttttagttatcattgccattcaaccttagtgcattatgtttcctatacaagcttgagtaatttgatgtgatttaatttggttgtttgccaaaatcttgataaactgttttgttcagtcaatagattaaatttttatgcgcatttaggtggttgaaaattgtctatgttttcctaaatgaatacacgaacaggtgatgcattgcacagtctacgcgtcaatttacaagatcctaacaatgtgctacagagctgggacccaacccttgttaatccttgcacatggtttcacgttacctgcaacaatgacaacagtgttataagagtgtaagaatctgttttctggtctacctccatttgaatggatttgcaattccactctcttgtggtggtgagcaatctaattgcagtttgtgctcccataacacttgttatatgatcaacctttccagtgatttaggaaatgcagctttatctggtttgttagttccacagcttggccttttgaagaatttgcagtacttgtaagtctcacttcatgaactatgtttggaattattttacaaatttagagttggaaaactggcattgagtgtattggtttttccagctgttgaagattttcatattacctctagaattcgctgcatgaaaataatgtaggtggcttgcatattaacttttgcataaaaacaaagctgttgtaagtggcaaaaatgagcagagaacactttctcctctccatctcttgtttcacttgatgttgtagtcgatggcatagttgttgatgtgttccctgaacaacacaaatttgaatgtgtacttcataaaaaaagatttaaatatttgtttcacattacatactagtaaattaagtaactcagatacttggatgagactagcaatgaagtaacttatgtggcaaagtagtgtctgtaattgcttgtgaaaacattgtagttgaacttaaatttttgtcatacactcccttatataaagataagcagagtaatcgttaacttttttatgaactcttaaacagagtattattctaaatattattactaatgccagtaccctaagcactcttaatttggaatgacaaacttcaactcatatcaaatcctttattccctctttccttgttccatgtagactctaatcacgatttaggatgatggaataggataaaacaaacaagagaaacaagtccattgtaaaagtaaagcaaaatctagacttaaaaagaggaaatatggcatgagggtaggttgatgtcttggaggagaagatctgaagttttctggtcatataacagatgctattctggttttcaccaagagttcgaatcatgattcaattaagcatagattttgtacaagtgttaagcttagtttggagttcaatataccgttcacttaaattacatctcaaatttcattgttcttattgtaacccatgctcttttgaagctgcaactgtatggaagttcacagagacagtatgtgcatgtgcacctggtgaagcagggcattacatgatgtataaccatgcatcagacaatgttataatgatgggtataattattacctagtgactgcttcatcctgctcacacattaatatattcctatggatgcctagatttgcttgaggcttgtgtagtacgcgtgctaagtattttcctagtgtatgcaagtgacaatcacatcaagaatgaaacaatataaaaagaacatcaaaagtataacattatctttgtcaaaaaaaaaaagaaagaacatcaagagtgctgatggaatttaacaatcaccgggcatacacactgtttagatgaagttcgaaattaacataatgacagacgttaaatttttattgatgagttatatagattgtataaaatgtttgacgagctgattctttgcagcacatgggacgacaggtttttatatagaaaagtgcttgtaaccaaatataagaaaatacctccatgaaatagacatcggtaactagttataattgctatcttggaactcctagacctttctcatttgttgacttttaattgtcgcttgatgccagtattgatggatgtgagaattctccttcattatcttggttgtcccattatcctagggatgtcattggtatgatatgtggaattgactcattctctggttttcttgtcacagggagctttacagtaataatataagtggtctgataccgagtgatcttgggaatttgactaatctggtcagcttggatctctacttgaacaacttcgtcggtcccatcccagattccttgggcaagctgtcgaaattgagattcctgtatgtatttttgttctatattagatttatgtggatattgtgatgccaaatgtatatttcatcaaccaagatggacctactcttactggcatgttgagaaaggaaaggaagcctgaattcttttctaggtttcacataagatgacctctattagtattatgtttcactcttaagttttgatggtagaaggtatttgaggacttcatgggtctgatatcattcataaaaccgatcttacataagtcttttaattttctccctttgttctaatccttgtataaaggaaaagaatagaagcctatgctttgtctgatactgatattgtaaaattaatcagagtttagtaatgggtgttgggatccttttctagaagagagaagaagtttagaatcccatgcttcatcttgcatttttcactgctgaagtttctcttgcttaatgctccacaaacttctttcttttggcttgactgtctaagaagtgtgccaaattgttctatcatgcagactcagcatgaaacctcattaactgcatcttgggacttactatagaactattgcagtactgcaacgttgactaacatgatttagtccaaaaggtgtttcaagtctgtttatcgggggggggggatgttttgaggctctttatcgtggttctgaactgacgccttcatttccagctgaagtgccggttctggctcgaagttgaatatgttttacatccacatattaataatttattaagatgattctccttgtcaaataataaataaattaagatgattcaattagtagccttttcttctgttttattctccattatttacttgtaccaaagatgaagctcattcctgtaaacctttgtgttttcttgcaaggatagtcggctcaacaataatagcttgactggtaacatcccaatgtcactgactaatatctcatcactgcaagtgttgtaagtacactgattattttgtgacttgatttagataattctttctgtcttccatatcttctcatgcatttccttttccttctaatgcatatacagatttacttatgctcaattcttgtctcacctgtatgtagggatctgtcaaacaaccgtctctcaggtgctgttccagataatggttcattttctctattcacgcctatcaggtatatttcatttaaggcggtgcaccatctaactggctggtggttttagcatgctactatttgctaatatatttttcttgtttacagttttgcgaataatttagatctttgcgggcctgtaactggacgcccttgccctggatctcctccattctcccctccgcctccatttgttccaccaccaccaatttctgctccaggtggttctctaaattggtgtggataaattgttctcctttcttttttcttttgttttttttgcttttttgcggttagtgattttagtttgtccatccaacgtaagtgagaatttgtgctatagaagctaaagtactgacaagaaagggggcagaagaggaaaacccatcttaactagtcaggcattagttctgatgggaaactggtatgcacgagactacatttagtctctaagcattctggtctttatacaaatttaattcagcattgtggacatcttttctttggtccccttgtaaattattatctgtggtatttgaagtcatgtgtctgaatgaaattaatcatatttatgccagaacttgtgaagattttcttttctttgtaaaaactgtcctggaaattagatctgatgatagatacaaatttgtctactaatttctttttgaagtgatttaattaatgaagggccggccaaaattatgtgttaaatatagtctagatcatatgaaggaaattaatcaaatttatgggaacttcaggaggaaatggtgcaactggagcaattgctggaggtgtagctgctggtgctgctctactatttgctgctcctgccattgcatttgcctggtggcgccgtagaaagccacaagaatatttctttgacgtaccaggttagcagtattcaaatacccaaccataagtccataactcctacttactctctcacgtgtttatggtttctcttgcatgttttattttttggctccataattaacgtctttgcttaaacttattgcagccgaagaagatcctgaagttcacttaggtcaactgaaaaggttctccctccgagagctacaagttgcaactgacagttttagcaataaaaatatactgggtcgaggtggatttggtaaggtatacaaaggacgcttagcagatggatcattggtggctgttaagcggctaaaggaagagcgtactcctggaggggagttgcaatttcaaacagaagttgagatgattagcatggcagtgcataggaatcttctacgattgcgtggtttctgtatgacaccaactgaaagactgcttgtctacccctacatggcgaatggaagtgttgcatcatgcctgagaggtgacactttctgaaatctatcactccataaatgttctcacctttaatttggagggtattattgcataatgcaagaatgtctttcgctggttaacattctatcttggcataacttactctttataacaaaacatattcttgttagttattttcctgtaactttttaaaaggtagaagtataatttgtattgtattctcttgacaacataatttattttatcagaacgaccgccttctgaaccaccacttgattggccaacgcgaaaacgtattgctttggggtctgccaggggattatcgtatttgcatgatcattgtgaccctaagattatccatcgtgatgtgaaggctgcaaatatattgctagatgaagaatttgaggctgttgttggagactttggtttggctaaacttatggactacaaggatacacatgttacaactgctgtgcgtggtacaatcgggcatatagctccagaatacctttccacagggaagtcttcagaaaagactgatgtttttgggtatgggatcatgcttctggagctaatcaccggccaacgtgcttttgatcttgctcggctggcaaatgatgacgatgtcatgttgcttgactgggtatgttgtcatacctgctttacatgtgaacatgacacgagtaccataatgtgttcattttttaatctgtacatcacaacactagctgactaataagtatttgtgcctttagcaggaatatttaagtctatgactaaacttgttgaggttcttgtttcaggtgaaaggactcctcaaagagaagaaactggaaatgctggttgaccctgatcttcagaacaaatatgtggaggctgaggtggagcaactgatccaggtagcattgctttgtacacaaagcaacccaatggatcggcctaagatgtcggaagtggtgagaatgcttgaaggtgatggtttggctgaaagatgggatgagtggcagaaggtagaagttctccggcaggaagtggaacttgcaccacatcctggttctgattggcttgttgactcgacagagaatttacatgcagttgaattatcgggtccaaggtgaccgacctcgtactgctccaagtaaagaatatcaaatcattaggaactctttatttttgttgaccttgtgaaagtttttctttgtgaaatttaatgaaaatctccagttgtaagcccatgaagtgtgtctgttacatagtgcatacaaatttgtaccgacaggaaattccaaatccatgccccgacaagttgcacataggcttagtagtttaagtgttttaaaattgtccagcacagttaaactactgtcaagcagactcttgttttcagtgacattgaaaatgctatcaatttgacaaggttatttacaagattttggattttaaaatcaaagaatagtgcttcacattctcttgcggttattatcataccctcctgctacaagataatggcagatatttcagcaattaggccacttgcagagtttgttttgccactacatgcacaagttttgggctctttctgacgattcagatttagagcagacgctctgatatgagtacaaggtctgcttatttatacttttgaacttctctgtcattattttttactccaaagaaaatttcttacatgcaaattcatgaactgcatactcattaacatacaacgatccattgaatgtactacagaccaaagggataataagaataaacaggagaatctcaaaactcacaatcaacaaaaaccagagcctgcagaagggtagagaaatacacttcacttatcatgactagacctgatattatctttgaacgactgtgaacgagaactgggattagagccatttgttgcattaaacaggttgggataagaataatatgtctcatcgtccatggaaggcaatctctgtggttggtgaagaccctgaccaggatgatgaatatgggagatgggagactcaacacctactgttgaatcatcatatgaaggaatattcgacacctgatgttccaatggactgccatgaagtgggctggggataccatcggagtttgatgatt

SEQ ID NO: 402 - DNA, 5311 bp, Solanum lycopersicum
ttgattaatgatttttgataaaaatatgtgtatcgaaaagtttagagtcgcacatatttatttatgaagtgaatatagagatttacagtttcatgagtaggtgtacctaaaatctccaacaagaaatctatcatgatacataaatattctgtttgaatcattgttatctattgtttcataatgcattgtgttatattatacaatatggtagatacagtgtttggctagactgtattgtttgttattgtttaataacgtttttattgtttggtttgactacatcgcaatgtatcgtaatttatgaatttatcaaaatattctcaattattctaagatatgaggtttaactagaattaaataatataaagtaaagcgttaagaagtattataaaatattatgtgagaatataattggaaaaataaatttagtaacaatgaaaaaacacaccaaatcgattgttccataaaatgagggtttttattatttcgtaacaacgaaatttaacaaggcaatataatacattttaagtaacaatcaaaataaatattgcaggtataataacgatacaatacaatacaatagataacaattatccaaacagagtgtaagattcttttgtgaagcgctctttttgcgcttgttaggcattttaattttttttatgaacttttccatttaaattcaaatttagttgaatttcaatatgtaggacttctcgattcaaacccatattgaattgaatttcaacataaagacgtttcttattaaattcaaatttaaatttaattgaattttaataaattcaaatttaaatttaattgaatttcgatacaccgaaaaatcgaaagaaaacaaaagcttaatcccctaatccaaaaaggtcactgagcttcagtctcaccaaacacgtacctccccttaaattccaagaactttcccctttaatccaatcatcctggcggctactatattttttctccttttttgactaaattatttgtcccaattcgattcctaatccatttttttctctcaagatcatattttttggatacccttttgcttattgaatcattttgtggttgaatttttttttattagtgaagagatgaagatgtttgagttatctgattcggattcgtttgctgtttttgcatcatcaaagaatgtttttccaccgggatttaggtttcatccgactgatgaagaacttgttctgtactatttgaagaagaagatctgcgggaagaggattctgcttgatgccattgctgagactgatgtttacaaatgggaaccggaggacttgcctggtatgttatgatatgatttttgaatctggggttttgattttcttggtgttttggggtcgttgacttgatctgatcatgggttctgaatatttttgtgtttgtatttgtgatttttgagctatttattgttgagggttgtgattgatctatgtattgtagtgacttttcttgtgttaattgcatcgtcttgttctatacttctctttagagctacaacaattacattagtttgtgtatatgaacctccatgtgttacttttcatagttgttatactgtgaagagttaattgtgcttgttcacttgacccctgagtgtctttcggaaacaacctctctctacatccatacctccatgagggtagtggcaaggtctatgttcattcctctccctagaccttacttgtgggattgttattttttttgagtttattgtgtttataggtctattgctgtgtgattgagcttcaaaggtggttatttgtttatacaggatcaattgttgaattaatttaattgaaatagcttcatggacctgtgtttatggcctaatttcttaactctgttgttgttgttgttgttttccttcctgtgttttctgttctctaggttggttggaggttagtttcagctgtatatgtgtttttccgaaatcaaaactttaatagaatttgtattgattgaagaacatatgagaattatgatctaacatgatcttgagtcggggagatcatttgtgaaagtccagagatatcagatccagtcttcgacatgcatttctttacctttagttatcaaatgtaaatgtgatcattctgaatgctgttaagccaagttcttcccctttttgtgttttgtttgcttttcgcttttttgtttctttcgttacacttatctcattcatacctgttaattgttctaaatttaactggtactgctttgtaaaatcatactgtggcagatttatgatctttgttaatccttttgaatggtgtactcatgaatttgctatttgaactgcagatctatctaagttaaaaactggggaccgccagtggttcttctttagccccagagatcgaaagtatcctaatggagcacgggcaaacaggggaacaaagcgtgggcactggaaagttacaggaaaggatcgaatcattatgtgcaactctcgtgctgttggacttaagaagaccctagtcttttataaaggccgagcaccggtaggtgaacggacagactgggtgatgcatgagtatactatggatgaagaagagctgaaaaaatgtcaaaacgcccaggactactatgcgctttacaaggtatttaagaagagtggctccgggcctaagaatggtgagcagtatggtgcaccttttagagaagaggagtgggctgatgatgaatgtcctagtgccaaaggctttgtccatcaggataattccactaaccacgttattgaagctccttctgtggatggtggacttgaggagttgttgaaccccgtgcttatggagccactttctgtagattatgattatgcagtggagcagcttgtacaggaggaagatactcgaagtaccttgctatatcattccgcaaaggaagtcaattttccccaccgcagtgcggtgattgccccagcaaaggaaagctttgacttgacacagtcaggcacatcacagcgacagttgcatgaggcactagaagtcacatctgctcctgttatttatgaacagcagccacatgtggtggaagaggattttctggagatggatgaccttcttggcccagagccaagcactcagaactttgataacttggggccgtgtgttcaaaactttgatgaggcaggccaaagtggtcaaaactttgatatgcctgctggaaacttcgaagatttgccattcgattattttgatgggttggcagagtttgacctgtaccatgatgcatccttgcttgatgatgtaagaacaactgaagtggggcaaaatactgaaccacacatgaacaacttagtgaatggttctgttaaccctgcttctacaacgtatataaacactttccagcatgaaatgatgaacaaccagccaatgtatttgaataattccgaacagattagcaatcaactgtgggtacacgatcaaaggttcaatatctcttaccccagcgaggcaaatcagttggttgctcctccagctacttcaggtacccaaatgatctcaaacagcaataatgtaacttttgcttggcctatgctgtattaatgatcttttacgattttcataaaacacattttctatgtgatctgactttatggagctcttggcagatgatggtataagaataaccatgtcatcttcagcatggcgagaactctattgcccaagtggaaatgggggagtttgagcctgcaagagctctgctgctgctaatatattggtgttgagattatttttttcccctaatttttgcaagttttggcaatgttttaggtgttgtatatgatagtattttggcaaatcatcctatggacgcaaatcaaaatcaactacccaatcaagatgaaggtacaccatcatggttaacctctcagttgtgggccttcgtggattctatacctactgctcctgctatagctgctgaaagtcctgtggttaatagtgcctttaagcgcatgtctagctttagtaagatgagaataaacgccaggaacatgaatgttgcggcagcaggtaacacagcaacttcaagaagttcgcgctactctaagaatgggcttttttatttttcttttgttggaatactgtgtgcaatcttatgtgtattactaggaacatttgtcgacatcttgaggagacccatatcctcttaaatatgcaaagaaaagttgatgttctatcatttggcatcttgccagaatcaatgagaagcagagcatacattctatgagtaaaacaaaatctacttataagtatgatgtctgaactcccctttccccttggtggtcgtttggttgctggttagagttatgcatgtattagttatgcgtaaaagaaaaacatacaaaatctacttataagtatgatgtctgaactcccccttcccttggtggtcgtttggttgctggttagagttatgcacgtattagttatgcgtaaaagaaaaacatgaaccaagcattgtattagcaatgctacgttttacgtgaaaagagaaaaaaacaaccaaactttgtatactttatgctagattctacatgagtattatatttcctcattttgtaatcaaccaacttacaaagttatgctagtttttagtacatgaataactcctcttttatctagcaaccaaacaacctctgtaccaccctaaagtagtaacaaaaaggataaaataacataggaaatatccctctagtgaacagaagaacaaggaactatgtcattggcaattttgactgaaagttttgagatcatttcataatcagtttttctttgcttttagagttatgatttgcaggtatgcataattggcttaatttaggtgagttttcaagtttgatttctgatttggaaggttcaatgtggcttgaaatttgatgttgtgtctagttttcttgtttataggttggacaggttaacctatttgaacaggtaagttcagattggtactttgttttcgttactcgagaggaaatcgatttctaacttgtcttttgattatgcagcatgatttatcatcagctgtataatgaagttactacctgctattcttactttgtaaaattgcttggtatgaattgtttgtccttcagctcacaagtttttacaaattatgttcaatttgagcatggtctttgtcataccctaaactggaccaagtgactattcttaatctagctgaagtggtaagtacactgtcattcttaaccagagtttcaggtttgagcccgtggtatgatgttagggaatacttgtgggactggtagcaaaca

SEQ ID NO: 403 - DNA, 5468 bp, Solanum lycopersicum
cttgatcttacctctttccagcagtaaatgcctcttttttctcctgtatttttcggaatcatttgtaataaagatattggctagctacgattgaaagaggttttatcaatagaattctcatctattcgtgatctatgtactggatattgaacatatacagatgcaaggcataccgctaaggatgtgacggggtagatggactcttccacgcttaaccaaaggtcttgtgtgatcgacactcttattttgcccatattaatttgcgaggcaaatgagaatagttcataatgtatagaggaatatatgattgtggtaaattagttgttaataaatcataatttccatagcaaggatgtcttcactgagcacattaatcttctttgcttttcaaaagtatattccttctaatagagcattatgcgttgttatattgtacctctattaacaaattaccattaaaaattagagaactcccaatttgtaggtcgaaagtagcaagattttcgtgacataaagagctagggtgtggtaaaaatggaaaatattctttctccttaaattatatgttttttgggaccataatgaattacggtgattctgatattcaaaagtctcgagtttatactaatgagagagaagaaaattttattggccgtgttaaatatatctgcgaactattagttgaactggaaatcctaatgtggttcgaaagacagagagttgatgtgggaggcttttcaattgtgcatgaaatatagataatctctgtcatactccgttcaaaaactagagcatatatgtccgaagactgagtaggaacgaacatgtgtgacaatcttattcgttgtcgattcgatatttaataaatattggatcggtgaataagatcatgatatgttctttagtataaatgatatatatatatatatactttagtttttgaacagcgtacagcggtatatatttgtcctttccctttctaaaaacgagtcttacaaaagttagacaaaatatttggtaaaatggaaaaaagaaaagagataagaaaactaatgttaggctaaaactgtttgcacggctcctcactgtatcatcaatggctgctctgtctgcttctgcccatgtgagaattcgcaccttcttccattcatctttcactaacaataaaatatcaaacttctcccaacaattcaaacttgaaaattataccactattactactattactacttcgaagagaagcatctccatacccgccttggcaccaaagacaacggagaactcagcttcccaactccaatcaacttcagattccgttaaaggtaagcacaaaaatacaccatcaatatcagaaatcaaaaaatttgggtttcgtccccagaaatttaccgaaaaagagttatagattgagacttaattaccaaacataacaatagtttggataattaccagatttagcaacaggggttgtatcattgatattgcaatagatacatacaaaacaattgtggtatagagggagtgaatttcagaaactgttgtaatagtgatgcagggcgaattttataaactttgctagatacttctcttatagttttttaatatataatttttttcacattcactttgaaaattaattaaattaacgtttgaaaagcaacaaaattggacagagggatagaaatttagcttatcaaacaaaaagaatgtcttagtgaaagatattttgtaagttttttcatgagttaatttgagttacatatttgttcaatttttaaatggctggtaaaatataattttcatgtgctaattttgagtaaattttccttcttttttgcttttatagactctgaaaatatcaatttgaaaggatgggctgagtttgcaaaaaatgtgtctggcgaatgggatgggtttggagcagattttagcaagcaaggtgagccgattgaattaccggaatctgtagtccctggagcttacagggagtgggaggtgaaggtattcgattggcaaactcaatgtcctactcttgctcgtgatgatgatgccttctctttcatgtacaagttcattcggctccttcctaccgttggctgtgaagctgatgctgcaactaggtatagcatcgacgagaggaatatttctgatgccaatgttgctgcctttgcgtatcaatcaaccggatgttatgtggctgcctggtccaataatcatgatggaaattataatacagctccttatttgtcatgggaattggagcattgtttgattgatcccggggacaaggagtcgagggtgcggattgttcaggttagaggtcatgacatgtttattgattgattagatagtcactcaagtaatagttatactctcagaaaagttgctttctttcttgaagagaaaattggtattaaaacgagatttgactttatgtaagaactattagtcgagtgtccatatgagaaatcaatccttcattgtttttacctgcccaaatttaagtcaatccgcccatttgtcacctctaattcaggttgtgcgccttcaagattctaagttggtattgcaaaacattaaggtgttttgtgagcattggtatgggccgtttcgaaacggggatcagcttggtgggtgtgctattcaagattctgcatttgcttctaccaaagccttggaccctgcagaagtcattggtgtttgggagggtaagcatgccatctccagttacaacaatgctccagaagtaagcactaaatgaccctatccattgaactgtgcgacatctcactaaaagtaaacacatacaatactatttgttattgggtggtagtgatatttgaacacatgacatcttgcctggctctaatagcatgttaaattgtgtgagcatttcatctaaaaacttatttagctagagtatacacttctaattacttaattatattatgtctctccactatcatcctgctattatcaagttgaagaaggttttctacttgtgacttggaatgctgactaacattacataacacatagtccagagcactgaatatcccatgtgattattgtaattgtaggtttttccttgctcaccttgtttttagtgcagcttcaacaacttcatttggagcagaattaatagattttgatattttagtgccttgactgcaagttagaagtgttttcagaattgtacttttttagaatttcaccatacgttcagccttttgctttgacttcctagccccagaggttgacaatcataatctcatacgttgattgcatccaatgatcacctggtatgggtagaacttcgaaatttgaacgtagaaaccagacgcttcaccttatttctaggaagttaaatcaacaaagtgctaaaggttcttttagttccttaatatttcagtgaaatttccattttaatcatgttagatgtccttttcttgctcaggcaataaaaaccttcacaccataatcaacaaggatttaaactgttgacttgatggcagagtagttgaaaactaaattagattgacaaagagaatagtgcaccaaacaccatcttattgacttgacttttcagcttatatgttttcaacattgtagtttctttattgctagcaatgtctgtggttaaatcagagataaagaatttttagcatgtcagcatcagaaggaataagtaatggagagttctgaattacacttccagaaagttattcaagagcttgtcgatggcagcaccaggaagacagtacgagatgaattagatcttgttgtgcttccaaggcaactatggtgttgtttgaaaggcattgcaggtggtgaaacttgctgtgaagttgggtggctgttcgatcaaggacgtgccattacatccaaatgcatattttctgataatggcaagttaaaggcaagtagttctctttttgtttctcctaaaaaggaaacttttttgttacttatttattctcagtctgtttttaagctgttgctgctttcatatcatcgatataccttcttaaactttgtatctaagtcaaaatcaaacaatcaaattgaaacgaagaaggtatcaacaacccaatttttaaatggatcacaatttcatagcacctgcttattgtgacactctgtctgatattcttcaggaaattgctatagcatgtgaaagtgcagcaccagcacaataggtcacaattacctacaacatatggccagtgcagtaggaagacaactgttcaatttcccttatccagaattaaattaatggacaggaagtatataattgtatattcaacattggtttattttcaagtggcaacaattatgtttaataatggtctgagataaatgatattagttgatataagctttttagttgagtgagaaacgattagtgagaattcatataaccgatctcaacttgataggaattgagtatggttgttgtaatagctaataacccttctctgctaatgacttctcttagttccttgtaccaaatgattgacatgcctccagcaaaatctttttaaaaaaacttccatgaaagtacaacataacagtattactataaacaagcataaaaataaatagcataaattatcatgagtagaaaagtgaagcatcattcatggaataaaacatcatatgataaaacaacataatttaacaatttgaaacgaggaagcctttctctaaagaacaagactaatttgaacacattagtgggaatattttcaacactaaaaactaaatataaagctcacaacaaatcgtggaagcatagagctgtccgatagggtctttcactcatcctcttctagcaaactcgaaggtactggatgttactggatgaaagtctattgccctggcctcttttctgtacaacctgcaaactagccagtgcctaaattagaaacttctttagtagaatacatgatcaacgccgccagtcttcttcagtagaacacaaaacagtattaatgtaattttcttttaggagagctaagaaagttaggattatgtaattttcacaaaggaggaggagacgattgttcattgcttcttgtaaagagaaattagcaaatggtctctgggtctcaacaactcaattaggactcgaacagatgcatgaaactttgctctcattgaaacttgtaaacttatcaagctcgttaatctttcaatctttttttggaagctgactaagaaaatatatctcaaagcaccgattttctgcatccacttaaaaccaaagcatgaatttctactgaactcataaatcctcttcccctcttagctcggcataaccccacgctccccctctgttcggactcaaaaccaaaaaagtatgatagcttctgctcctatgcatcattagcccttttcttttcaactacatgatcctactattttcctaaccaaaaagtatgatagcttctgctcctctgtcatag

SEQ ID NO: 404 - DNA, 4972 bp, Solanum lycopersicum; identical to SEQ ID NO: 265

SEQ ID NO: 405 - DNA, 3094 bp, Solanum lycopersicum
aaagttttttctaatgtgttagagtattatgatttataatattttgtaaaataatttttaaatatataaattttatttctaaaataattcatgattaaaaaaaattaacaatctggctcttaaattttttaaataatatcaggtaaattgacagagagaggtagagtaattaagataaaaaaagtgtaattttaaataatatcaggtaaattgacagagagaggtagagtaattaagatgaaaaagagtgttttaaagagatatacatgaatggtactttgaattatttgttagatagaatcttaagttctcttttggccaaggataatataattaggaaccaacttgttttaattaatgtagctttgtagactttgtgttagctatgtacacctaccacagcacttatatacactttgaaaaatgtactaatcattccagactccatgattaagctgttagatattttatcaagtaattaattaaattccttttctcgatttaatagtatactgttaggatcgaattcacacacacttgataaatgaagaatacaagagttttcgagagagatgaaaaatctagagagagaaaccaatagtttgtggtaacacttcgtgaataaacttttacagtggtgagatatatatattaataattcagagtatgaacagttacagagaataaatacagaataaacagtacaatctaaaatttaaaccgcgtaaacattaatatatgtcagtatatcaaatattaatcaggctttataacctaacatataccccattaacctactacagtattaagcatcacgtacgaaaaaaaaatcgcatgcatgaaacctacttgtatagtatatatatatatatattttttttttttttaaaaatattctttttgccaagtgtgtttttctattctatttgtcttcatatacatgattctatacattaccactatttccccccactataaataccccatttactaatcaattttcataaatcaattttttggagaaaaaatctcaaaaatatttcaaattccaatggccatttctaaagctctctttgcttcattacttctctccttgctccttctcgagcaagtccaatctattcagactgatcaagtggtgagttattttatttattccttagcttacacaaaaattatatttatcctagatatattttgaactcgtaataaacagtcaaaaagattataatttggattagtgtttcatcataaaattatgtttcaaacgttttctttactacatgaaaaaaaattagtcgactatctaagtatatatagaaaaatttaatcatattccttaatttttcaagattaatttattcactggtgatatatgtttgacttttgcagagcagcaatgctatttctgaaggcgctgattcctacaagaaaattggtattttctaatttcttattactctcccgctagaatgccatacaacattttgtcacctttttcaatttataaatatctattcccctatgtcatgtatcaattataaataatacgcttcttatatattaaacctcgaacatccttaagcgaaattcgagcatatataactaattattaatttctcatatatatgttgtttacgtacagactgtgggggagcttgtgcagcaaggtgccgattatcatcaaggccaagattgtgtcatagggcatgtggaacttgttgtgctagatgcaactgtgttcctcctggtacttctggcaacactgagacttgcccttgctatgccagtttgactactcatggcaacaaacgtaaatgcccttaaatttcttctaaaaatatcgtatatcgtgtgattaccacggatatgttattattgtagtgtattattttgtcatatattgtgtcaataatcaaaatccagtaaaatatctttagcgtgggtaatttattttttggggtgttgtctttgtaattttgaggaaattttatttgtgtgttgattagtacatctggtgtaatatttattctggtttgcattgtattgtataataagatgaggaataaatgaagtttgagtatattattttatatgtgttttattcttggatgttaagttttatagtacggaattaaataaagattatttgtctcattcgcagctcattatttttcatactatcgcattgcttctaatatacttctagacacgaatggtttaaaagaacttttataacatcatgttacctgtggtattgaatacatcagtaaatgaaaattataaaacaaattgaaccagaaggaatatagtaaacaccaaaaaaaaaaagttcaacaattggacttgcatcgagtactcttttaacatattcgaatgatgagactctttttcgtttattttgtcgaaaaattttcaaagatcagtgacgcacgattcaaatagtgagattctttgtaagaataccctcaaaggtaatcccagggccaaatgcgagaatcaatccccaatcagtgatgtcttttttctcctccaacatgtattccagcacatacacaattgtattgctacttgcattaccataatctgccaaagctcttctactagcactcaatttatcaggagacaaatctagctttttctctagcctgtttaaaatagcaggaccacctggatgaactgcccaaaacaatttgttgtattctctatctttgattccagaaatatttattaacttgtcacagaaatcctcaatattatcttcaattatctgaggtagttccctttctagcttgaagctaattccctcttcagtaagcctgcaaatttagaggtggctaaattaatctattaaagtaatttgtctaagtttaaacaggcttgactgaggcttggacaatcctcctccctataagctagttagtttttggggccataagttaggcctatgacttaatttaacaaatttatcagagcagagctcgtctcacttgatgttgagatctccaaaatcaaaattgtccacgcaccagatactgagcactgggagtgagatggggtgttaaagaatgacaaaaatctcacatgattaatg

SEQ ID NO: 406 - DNA, 9481 bp, Solanum lycopersicum
cttacttgaatagacaataggggttgtttggtcgatgaaataatgtaatacaatttgattcaaaatactaataaactattttgattgttaattatggtgagatgattcgtaatctcttcatgtttaattaaaatttttgtttgaactctttaaaattaaaaaagtcttattcagagtattgtcctcataaataaatcgtgcaacatacaaattcaaatttggtcattgtcaatgtggatacataacattaaagaaaatgttttattgaaaaatctctaaaattgttttgattgtcggtgtgatgggatgttgattaatgttgttcataattaaattgaaattggtaagttcgtgatgggatgttgattaatgttgttcataattaaattgaaattggtaagttcgtgatgggatgttgattaatgttgttcataattaaattgaaatagataagtttgaatcgatcattggtttatcgataatagcctaataggttattggtttaacgaatttagtaatggttttttcttacatcggtcatcattttttttaaccgtttgagattttttcttaatgagttaaccaataactcaatagtaagctaaataattatatttatatcatttgacatataaagtctaagttagagtttaatttcgtatttttatttttggctatctcaaactctcagttatcctgttatagtgtttgcttttgagcaatatgcaatctatcaactaatgtgcatggttcatttagtttgtcaccttttttctaagtaatattaaataattttttcggtgtcaaatattaactgttaaatcaataacttaatcgataacgaccaacaactgataagttagtatcttaaaggttatataaatcgataaattttaaaattggatcgaaccgatagatacgcaactcaaaattctaaataaaattttggtctgattaaaaaaaaatctgataaattgatttttagcggttaaaattaaccaatgcttctttattcgccacagttcaaaacttctccaatattttacctcagctccaaatcgatcagatttctccgttgctcaatttcccggcgacttctccaccggaatttctccatttccggtaacgattccgccagcaactcgccatttttctttcttatactgaaatttattatttacttgaattcaatttcataattttgtttttctctcgtcaatcgcgttaaatttaggtcgaagatggaaactttgcggaaatcagcttttatgctttttctagttaatgtaattttccgttttaatttctgaatttggatatatacacaattgaaaattgcatttcgagttgtaatggtaaatattttctgttctaggtctatgtattaagtttcttcaatcatatgagtatgtatatgcgataagtttttatacctgtgaaaattgcatatcccggtttcaatttatttgtctgatttttactttaacagaaataattttttttttaaaaaaaggaaagaggcattcttttttaaatggattaaaaaagtaaggcaagcgaattgaaacggagaaagtatttattatatgtgtgcattttcacatgtaatacatgatcagcttgagttgatctagattactgattagttttattgtgattcaattgacaggtttttgatgagctatagttgaaggttgctttgcttttggtgatctgtgggaaatgagtgttcagtgatgaagaaagtgaagagaaagcttgggaagtatgaagttggcagaactattggtgaagggacatttgccaaggttaagtttgcacgaaacaccgagactggagagaatgttgccattaaagtcttggccaaaagtaccattcttaagcatagaatggttgaacaggtattaagatatacttcccttcaaacactcgagtatatgctttacatgtcctgcatttttgttattttattttgataacagtggtgttcacatatcccatattcaaaggttggagcttgataattagaaaagttattctaatctgtgaagtgattattattgaacttaggtctgaaatcttttctgtcgaacttcagtaggcttttctgatctgatgtgaatcaagggtaaccatgacagcttcagtggtggactattaagctcacattgaacgccgtagcaatgaactctgttatcaaaattgaactatgtgaatgtgcctggtatctgagctgaattctattagtgaacatcagcatgttctccattattgagtaattatagtcaaattttagttggttgatggatttttaagcctcttaactgatggttggcaatagtttagctgtgtaaaagaattaagatttgatcatattgaatttttattatctgtttgcatttgaaatagatttctgtgttaatagagcacattctggggtctgtgtgtgattattctaccgtccttgttatccatgtctggcattttggctgatcaatgtgctgttctttgagatggtttccagatcaaaagagagatatctataatgaagattgtcagacatccttgcatagttcgacttcatgaggtaaaaagaaaaaaagaataaaaagtattatattacaaatactactgtgagtttggttgttctattatcgttgctacttgctgttgctgatgtttattgattttgtgttcccttgtaggttttagctagccagacaaaaatatatatcgttcaggagtttgtcactggaggagagctttttgataaaattgtaagattccttagaattttcaataagatttttccttctttaatcaataactcttgcagacttcttgttccttgtatgtgatgatggataactctccatctgataatgactaggaaggtaatctgtaaatgaaaatagaggcacgattgagacattgttgcaactaagatgtgtgcccatgacgaatttctatgaagtgataatcttcatttattaggatgagctgtagtttgggtcaagatacttatggaggatggggaagtagataatggagtgagcagcagatatctttggtgcatcctatacaatattcacaaagcaatagtctggtggagtaatctgtataatgagaaatagaggcatgaccgagatatctcttttttatatttgaaaaatagaggcatgctgagatatccgtagaaaaagacattctgtatttggataaagtaattccagtccatgctttttatgtggagagcttggagatcattttctttactctcaaagcagttaagagtgtgttgagttaccttctagtaagtcaaaaattccatctgatcaagaggttcctctggataggtgttaccagtcttatttaagcacaagatagtgatcggaaatgcttaatttgtcagtgacgatttagctttaaatcagtttttctctgtcagagatgaactctatcgagaaggattattttcgcttatgaactttgtacatttttttcagtattcctgaatagttggtatgaaatgcatgatccagcctggttctgatcaactaaatctcatcctcatcaaacatataaattgttgggttacttaggtataagctggttcattgatagtagtccagtttccaattaggcacttgcgtctttactagtttacttcagctcatggagctttaaccctttatggtttattttgtccttctccctatgagttatcaaggtttgattttcaagatttagtaatgtatctgtctcttcaattctatattcgttcaatttataggttcatctaggtaggctttctgaggatgaagcaaggagatacttccaagaactcatagatgcaattgctcactgtcacagcaagggtgtttaccacagagatttgaaggttcgcaattgctgattggaagagatattttgtgaaaattatatatcttaatcttttaactattgctccttgttccccagcctgaaaatttgcttcttgatttccaagggaacttaaaaatttctgactttgggcttagtgcattgcctcaacaagtaagcaacatctgatgttagttgcattagattgtatatctatttttgtttctttccttgttcattagagcttctaaatgggaatttactcaaatctctaacagggagtcgagctcctctataccacttgtgggactccaaattatgttgcacctgaggtatgatgcatatatattttgaatgttcttcttgttttgtacatgcaacccttcattcttcatttgattggcttgctatcccaaaaccctttgttgagaatataattgagtaataaaaaatgtactctctctaacaccttaagcttttagatgagatggtcacacacttcaacatggtatcagtgccaagcagaggtcttgagatcgaatctcaccaccacccaaaattaagaagaatttccacgtgtttggcctgaatttattcatgacagtttcttatcattaatatgtaacttgcaccagctatacttattgtttggttctgcctagatttaagttatatcattaatatgtcactgagtattgtttgattctgccgtgctagctccgactttcaggttcattgattagaaacttaggtcctcttatctattttcccattcctcatacatcctcaatgatgtccacaataataagcaccgtgtgtatttgttttatctgcaaggagcttgaatcagaaagaagcgaagcagaggggtggttgtctttcattttaattcattgctatcccttttacctagcatgatcaattggcttttgattagtcatcaaatgagagagaatcagaatttatttcccttccatgagctctgtagtaatataccttcaaatcattgcagtaactgtcagttacctttctttgggtaacatcataaccttgtgctgaattgtttaatataagaggtttgcatcaagttgaatttgtctgaactatgtcaattgctgaacatatgttaatttgcttactatgttttcttatattcgaatgtgtttggactctttctgtggtagctggcttattactcttagttacttcttcaggtgttaggtaaccgaggttatgatggtgctgctgcggatgtgtggtcatgtggtatcatcctttatgttctgatggcaggatatcttccatttgatgagacagaccttcctaccttgtatacaaaggttagatgcagtcatcatgcatttgtaatgtgttaaatggaagcatagataattctgtcaaatgattctctttttcttcttatatagtgacaaatgctaaggatcataggtcatatgagggacaatatttgttcttttctcatatgtatattattcatttctgattaggattgaggtgtaatgagttgattgatatatttattcagctctctgacctttgtgtgaaggataagctctctttcacttggcatcgaccacactgctctcataaaaaatattgttccgtatttttaatttcatcttcatctgcatgagtttcctccttgtgttttttattattaccattatttgttttttgtttgttttttattagattaattggggctttaaaagaacttgacattacttgtacacggcttgctatatgttaaagttattgtttgctctatgtgtggcttactatatgttaaatgttatggtttgttctgcacaaatttcttattgcttttaatattgacacagatcaaggctgctgaattttcctgtccattttggttttctcctggtgcaacatcgttgattcaaaaaatcattgatccaaatcctcaaactgtaagtgcactatattttcaaccctgaaaactatggtgtccgattgcctatttgtcacttaattattcaatctactataagcttataacattaaagttgtactggaaaaacaaatccctcatgatgaaatatgagaagccccgtaacatggattaaattccttccaaatttcccggattggttatagaaatcctttttgaggtcattttaaatgtgagaaatgccttaagcatgccttctgctcattctttgcttttgttcagtataagtgttccttttctcattccctctttcttggttaatttgtgaaacttcagcataacatgtacaaaagtccttttagtgttttcatagtgatttactcagaaccatgtacatgcagaggatcaagattgatggaataaaacgagacccttggttccggaaaaactacagagctgttaaagctaaagcagatgaagtagtgaatcttgatgatatccatgctgtgttcgacgacattgaggttgaatcttttcacattcgtcttctagtatgctaactagtatgtctgtgtgaggaagtgatcaagtttaagataaattgtactctggatttagattaactgaagtgattggcctgatacttcgatgttctcacccattataggtttgatatgttctatttttatgtgcaggatgcatttgtcagtgaaaaatcagaagatagtgagagtggtcccttggtaatgaatgcatttgagatgataacactatctcagggattaaatctatccgctttgtttgacagacgtcaggtacaatgattaatttagttcatggaccaaaaaataaaccatacccgacgtttccagattttaattcatcacaacgtcatctgttttatctctttctcccgcttcttcttgtaagcttttcgtttcttggataaggaagagaatctgatgggatatgtaaattgattcttccttgaatttttagttagcatgctcttatatagaagcacgttaatttatctctcactatttttggcctcttttttttctcctttttccttgtagtcaagtggctcagagccaatgctacataatatcaacttttctaaatctaattttagatcaaatacgtcgcgattattttttcgtttaaaaaaaaaagtgtcagatatgatctgaatagcttatatttttaatgattgagttatttatgtttctacaaatttaaaaatgctgacatgtgtagtaggttgtctctttgctattaaggttttgacaacttccttcttataacaaagagtaatttcctctctcattcttacaggattatgtcaagcgtcaaactcgatttatttcccgccaacctgctaaagtcgtcattgaaactattgaagcagctgcagagtcgttgggtcttaaggtccacacacgcgattacaaggtatatttctaactctccatattcagggacaaatgattctcttttattcaaatttgaattcaatcagaatgaagcattgttgtaactaaataatcagtttcccattggatcaactgtaattttcagcatttttttttacccttttcccacaatctattaaacagcaatttcctttcaacatcaaagaaaatggaatatacaggaggaattcaccccttcaatttttcctgctctttataaggagcaaaatcgtaactgtgccacataagctttagtcgcattttgcttaacactgaatgaatgatggttgtaaatttatctgttgcttaagatgcaaacatcttggaactaggggcagatctataattttataacacagagcgaggagtaccactcctttttgtcactggatacaaactaatggtaattctatcgtgttcttaaacgagaataccctgggtaagtttctcgttattgagtgggaattgatttattgaaccactcttctcattgcagacaagaattgagggggtaacggcaaatagggctggtcaatttgctgttgtgctggaggtaactttaaacttaataaaccgattcatcttaagatcggtgtttcttattttcatttgaccactctttctataatttgtgaaggttttccaagtagccccttccctttttatggttgatgttagaaaggctgctggggacactcttgaatatcacaaggttgcttctacactcaactttgactgattttttttttttcactatagcttgcattacatacttatatttagcttctgcacgaaaatgacgttatgtgcatttgcagttctacaaaaccttctgcacgaaaattgacgacgtcatttggaaaccgaaggaaggcatgtcaaatgctgttctgcttaggacaaggactcgctgaaccagatttctgggaatgaagtgaatcacttatcaatttgatgtgctccgaagacgttcgttgtgttaggtatagtgtgtgtaactgcatgttgttaatcttttgttcactacatatcttaagtgataaatcatgggctcaaaagcaatacaagtagggttgtaaatgagacggttcgatcagttgtaaccaatttttcggatattatataatgtataaccaaaactagacttttcaaaaccatcccaataatatcggtttctctttggtatcggtacagttagttttcatttttaaaaaaaaaaataaattatcacctcaaagtatactattagtagaatatttctttattgcaaacgtgtttgcaaagaagcacttcaattcttcaccaagaagtcaagaatgtaaaaccttattgccatattgtttgatcttaaacatttaatacgagtgcttgcgtaggttttagtgtattttttgatagaatgcctattataatatcttttaattttaaacttaattaactaaaggttaattaaagagcaaagtcccacagttctaaacctacatattgtttttttttctttcaaaattcttcatggacgtccgttaataccttagctacggatcgagttgtccaagacggtcaaaatgatcaattttcaaggtcaaacaagtcccggagaaggttaatcccccattttcctgatttttatgtgctattgtgcaagaatttttagtgattcaaaattccgatatcatatttgccaaaaatattcatggacgtctgataagaccttagttatggatccaattggcccagacgaccaaaatgacccatttttaagtttaatcgggctccggagtaggtaaatccccaattttatcgattttcgtgtgatatagtccatgaatttatggtgatccgattccaatgtcatttttgctgaaatttttcagaccttagctatggattcagttgaccctgacggcaaaaatgacccattttcaaggtcaaacgagctccagagcaggtaaacctccgattttgccgatttttatgtcttatagttcaccatcttttttggtgataaaaagttccgacgatattttttttgaaatttttcacggaagtccgttgataccttagttatggacccagttggaccagacaaccaaaacgcttcattttcaaggtccaacgagccccgggcagggaaaccctcatttttgctgatttttgtgtgttatagtcaatgagtttttggtgattcaaa

SEQ ID NO: 407 - DNA, 9844 bp, Solanum lycopersicum
ctggccatcaccatcacattcgcaatcacaaccactattagcaacaaatactactactaaccaatattgtcagtcgttaccatacctaccatctccatcattataacaatgttcactgcacactatatatcaaccacaatcactacaaccgatctctactatcaaccacttttactatcatattatcaacaatccacatttttcataatatcatacaacaatttattaacatcaaacagtttcaacattacaaccaacactattaatagccatcatcacaccaataactgcaacactaactatctctgctatcacaactatcatcaccaccattactaacttctaataatgacagaatcaaattttccactaaatagtctaaactatgaagaacacacgaaaaagttgaagaaggttcaacatctatgtttacaaataaagaagacattatgtatattcacatatttaacgttcagtattcaaattaagaaccaatgcatttagtcattcagatacacatttaaattcaaacattgcgatcatttataaaaaatgttttgatattattaaaatatttttttaaaaaaaagacgagacttgggtggctagttttaacaatttacttgaggagtcaaattttgctcttttcacttaaccaaacaaaaaaagttcaagccgtgaatcggtgagtgtgacactaaaaatgatgaacatattattatcatcaattcatttcctctttagtttgatctttttcccccctttttacctaaaatcttatcctcaaagctttgtcaaattgtattagcagttgtaaacttcacacagtgaatagtagttagtgtaccatacagctgcattcttgatttagggagttgggaccaacattttattgccctttccccctatttctcactttctctttcttgttgcctctttcttaggtatacccttttggtttttcacctcaaagaaccttgcttcactgttgtatttctgaatgttgccagaaatggggtcagaaggatcatcaagggttgtaggtaagcatcaaaatcttggaaaaagattggatttttattttcagttcaagtttggggtggtagatctttgtataactcttttgtcttgttgttcaaaaggggtctttttttttttttggattcatggggttaacaatttttgtgctgtttaaactctttatggtatttgggaatagggtttctttattggttttgttcagattaggttaagtgagttggctgatgattgctgacatagaaagtttcaatttttagtcctattggatgaatttggtgtacacttttatgggaaagttgaagtttttgttaacagaaatgcttgccaaattaaggtgaagttattagctgaattgatgcaaattttggaagttctgtttctataagaaactattgataaggttactacgctgttgtaatctgtagctgtggtttactatcggggtggtacatgtcccgttaccttgggtgtttggggcttaatcgattgtggaggtcgagtttcctttcttgacttgctactgcttctgtgtatgtgttgtttgtttggcttcttttggaaattgaaatctaacttcagagagagtttaatgtatctgagatatggatggttaaaaaatgtggatgtaaagaagggaatataatttataagttatgacataccacattaaaagatccatcccatgtcaaccataaatataacctgtcagagatatcgaaccttccatacttgtgagtggaaatccaattccattttggaatattttcatcagggattggatcgactatgttgcagtggaggagagaaggcgaaccaactttatttggttgcttctcccgtctggttgagtagcgttcgctccttccttcgcactttattataatgtaaacatactctgagaacccacgattctttcacaaattatctttttttgtgaattcgacatcagtgatctatggccatcctttcttttttccattcctaaaaggagtagttggatgataggtgctaagtccagtctggacatcgttcctttctcctctagctgcttgagggtaaatatttgaatgtgttgggtgggaactagtataagacaacatgaggcaaaatgaagtagctatgtaaaagcaaatgcttttattgtaattaggaataactaacagctacttttcatccatagcagagaagctatcaaaatgaatagaactaaacactgacttacattttcttgattagagtatgggtgattggctcgaaaaatattacttctgtggctccaaatgaggagtaatcttctctaacccaagagtggaaaataagaccttcatctatggagatgcccgaggttctaatcttggttccagtttgagttttctgtttaacttgcttgcatccttaatttaatgctgataattgtgctaaacacgtaaccagttatctttattagcttcctagaaacaactactttcacgagaaagctgttggccatctcgtcatttatataaggctaacggtaaaaggggaatattaaagttagtttgtttctaattatagtaaggtgacattattttttgggacggactgaaaaggaatgggtgccacataaaatgggacggaaggagtattaattttccttagacattcaatgctacctcgcagtgtaatgaaacttagcctaacactaccccttttgttgctctaaactgcataatattacaatgaaatgacattgttcagtaactgtctttattctttttcaaggaagctgttcttaatgcactacattcaacatactatatcagcatgttttgaaatcttcacctgataatatttgtgctcatgtccagtcccaaggaatttcagattattggaggagcttgaaagaggagaaaaaggaataggggatggaactgtcagctatgggatggatgatgcagatgacgtgtacatgcagtcatggacaggaactatcattggccctcctaatgtaggcttgctttatcagttctttcatgtttgtgcttgtgactcttttttgcatatgttcttgaagagactgattgtttttcccaaggatgcaagtgactttacaactatatatttgcacgtagacattgtattttggattttggacctaaatgttaggaggagaactctcatgttgacatctaaagtatgttattactcatttacaatggatactgaattctgtcaattaagatagtcaattgaaatcgtaccactcaagtcgtagaacaaaccaaaggtaacaacagttttgaattctcttccatgaaaaacataagtcacatttttcagagtttacatgttataaatcacatgaatcaattcaaattgagtctagaattaactgaattacagtttatagacttgtatgcatatcttggttattctaataagtagtaactgttagctgtaatggcagaattaccgttactgcagttaagcttcatggtactttgttctgctgttaatgaaaatatgttttttgattttggttctcaggctgatcttcagttacctttgctgactatttgatcatacctcgatttacgattttgttacagacttgatttgcaattcatttttgagatgtctttccctgggtatcctaaaaacaatactaagataactgagaggaaggagacttagggctgattatgccatatccatgtgctaagttattggagaaagtttatctgggttaactaggaaaataaactactgcaggtcccttcattttgaacaggattgtggctgcactagaaaaagaacaataattaagaagaaagtatgccatacaagttattgataaaaaatatgttcgcaatgagttgttggatgaagaggcagagagagaacatcccacttatgggatatcaatttttgagtcataattatgtatcatctgctaaaaaaagcatgatatacaatgtgtgcacaatgttgtatttgagtcattatcatttagaatctgcttaaagaaagagcatgatatggtgcatgtaatagtatgtactaaaatgattcagagtgcaagaggaaggaagaaggtaagcagtagagaagtagcaaaagaacaagtggtggaaaaatagagtatagaagtccgtccttgaaacaggatttttgaatgtgtctaaatcatttattatctgttaaaggaaaaatgatacagcacatatattttaggacatcagagtcagctttgttggtgtatgctattgctgacaatattgtgcgaactgacaaaactagcaagagtgtcaaccaaaagcttgagctatgtagaagcaatctatagagtagggttttaagatttgtagaagtaagaacgactatatatcctacaagtttagtcagcataaggaaaataaagttggggtgagtttagatggggttgtagtgcctaaatgcaaaaaaagttgatacataggcttgccgtttgaggagaatggaattgtagatgaagatgttacactcgggatcaaatatgcatggttgaaatggagaagtgcaaccagggtgttgtgtgataaaaggatgtctatttaagtgaaagatgttttgctgcacaaattataagaccaacaattttatatgagagtgagtattgggccactaaagttcaacacatccacaagatgagtgttacagggctgcggatcctaatacggatatgtggtaatacaaattagacaagatttaaaaaaacgaccacattttccagaaggtgcaagtggcacacattgagataaaacaagtgaagatcgcttagtttggtcgggtcctgcctcgaccttcatatgcactagtctttaaatgtcatatcatggtgaatgaagttgttaaaaaaggaaaggtaggcctaaaacacatggaaagtaatgtcttgaaagacctacaatctcttggaattcatgcagacttacgaaagatagagcataacagaagaacaaaatatacataggcaatagacactggttgagaatagattttagttctgttagtccttatgaggaaaacaaggtttaagtcatatttttcgtgataaggttaaagtttaatagtaaaggtaccatgatggtacaaaagactgcatcataagcagtcaacacctaaaacagcaaagcaccaattaaaattttcctaacaaatctaaaaactctatatactgatccatactctcaataacatcttttacaccaaaagaacagacttcggggacaagtattttttattccggatatcagagatgtgagcccttctattctcaaagtgttgttcctctccttccagatggtccataaaatgcacagagggatcagggatggtcctcctcagctgcttctgattccttgttatcttctgcccttgccaaaggttttagttatgttaatacatttagttgaggtccaatgctctctaggagtcttttggcctagtagagatttttttgctagttgaaaatatagagaacttaaagtatttctattattattattattatttgtattttgtataaggcttgtctaagatgaattttaattggataaacatgatcaatgaggattcatatagccagcccaacttgtttgggactgagacatagttgttattgttgtatcatcaagagctattagtgatcacttacaatccaaggatgaatttgtagttagttggcaacatgaactttgccacttaatgacttaacaagcaagtttgcacatatgatttattccaggtgcatctttctgccacaaggaactaaggacacacttgggccacaaaaactttgaaaatgacacttcgattttcatcgaagggcttcgatttttgaactccacctttttggtgaacaagaggatagtagggcacaatacttaccatttcaagaaaaaacattcagtatggtaaaaagcagcatgcatgtccttctatagataaaagaaactagagtaacaaggattggtattgcaggaaataatctagagatttgcctgcaggctctgcactgaaatatgttttattagttagggtttagataaccaatgagggggtagatatagaagagcgggaaacagtctagagaagggtacaaaaaagaagaagagatagagatagagagagcaaattagttcagagttcagactgaaaaactggtggagagcgggatgtttctagatgttggcacaaaggcatttcgacatttctgattgcagcaatggaggtgtttggttgttttggatctttttttgtactaaaagttattttctaagaaggtatcatctgtccaatttttggcgttattggatttttctgaatttaatgttagtgttgttcttctctgatttctgcttttctgaaagttgagttaccacaaaaaaagagaaagaaaaagacgatcaaagtagacatgttacagaagtcctgcatttgtgttgactatcactatatcagtgtctgatgtgtgtgacataggtacgagtacttcatgtgaatgcttgtagtaacagaggtgtttggttgttttggatcttttttttgtactaaatgtaacattcttaggaggtgtcatctgtccaatttttagagttattggatttttctgaatttattgttagtgttattcttctctgttttctgcttttatgaatctttagttaccacaaaagaaaagagaaagaaaaagatgaacaaagtagacatgttatgtaagtccttctgcctgcatttgtgttgatctatcagtatatcagtgtctgctgagtgtgatgttggtatgattacttcatgtgaattcttgtcattaaaagtagcaagaattgagtgtacaggtattgacagtttgacactctcatgtgttcatatgtactcatccttccattataacacttcatatacatacctccttcatctctttggataagaaactattatgaaaatattacacatcttatatcactttagtttcagttcatccccttgatactgtacccaacacattcaacctcgttaaaaagccaatattgtcttattggaataaaaagtgaactgctgtacagtcatacttattagttcagctgcttatggaaacctatgttacatgaatttgtctacagatgcatgcataccttccagtatgggtgggtactcgcatctttttttgggccattttagtgtacaacaactcctattttttagtttatgtggaagaatttaaggaggtattactgcccatattgcatttgttttacacgggtgcataaaaaagtaaatgaacgatcaatgcagtatggctgaaaatcttaaaatgaaagtagaactatagaaagacaatgaagtaactgcctccagctacggataacttgattttcaaccaccatgtgtgatgatagaaacaagatgtcagcattaggtgggtgggaatcatatattcatgtaataaaaaaaatgattgtgttagtaaacacaagttagccgttgacaaaatacagtggaccttaattctcgcttgggttatttagcattctttgaatcaaatatggtctttggtaaatgaaaattatccttctgtagttgttagaaaccgctctagtggtcttaatggagttgactcaatattagaatcaagacaaccgtctttctatcaaatgtgccttagtttgtatttgtttagaatataactaaataataaaagtgtggccattgacggcttaagattatagatgaaatggttacacttcaacatggtattagaaccaggcccatttcaattctttgttcaccaatgttcccccatattttatcgtccatgcttcagttaacgaggtctgggagtgcggggagtgttaagaatcccccatcagatatgacatgagtaattggtcttcttatatgattttgggcaatcctctcctccggagcttgcttttggagctgagttaagcccaaaatccatttctttaccgtattcaatttgtttttgcaagactgacaaaataattgcttgctactcatgccgactttgaccgtaaggaaagcaaaaatttctgtgataatgacatgtaatgttgacagactgtacacgaagggcgcatctatcagctgaaactattttgtggaaaggagtatccggatcagccacctggtgtaaggttccagtccaggattaacatgagctgcgtaaattatgaaactggtgtggtaagtaccacgtactttctatccgactttattaggtttcatattaacaaagtacgcttacgcgtgagaaagtttctcaggtagagccaagtcatttccccatgcttgctgactggaagagggaaaacacaatggaggatatactgatgcagttgaaaaaggaaatgacgtctccccaaaatcgaaaactagctcagccttctgatggtgagtctttactaggttgatcaatataaatgaacttctagtacttctcatttttattattatctcttgttctatataatattgccttgagttgagcgtctattggaagcaatctctctacctttgaggtaggggtaaggtctgcatacactctaccatctccagactccactttgtggctatatggctccctcagtaatatctcaatacgagcaattacagtaatgtaccgctttgttagatcaaatagcacgttgagaacaacaaaattacgatatcaatctgaatgaagactactttcttttgccaggcaatgaagagggccgggtggatcaaaaaggcctagttgtgaaatgctgcattatgtaagtttgataaaatactgaaagataataatgtttgtatataaccttaaaaaaatacgtagacgattccatagtatcgtagcatgtataactatgtgtatgttttgtatttcttattgaatcctccttaaattatgggatggattgatgtttaataaccaattatccaacactctgaataaggctaactatagttttcatatttatgatttgctgaattttggtctaatttgtttgagaattacaaatgattttcctcttaggttatggaagaacaattttcatgtgatttcaagtaaacttagtcataagttacgggtcgtttggttaggttcaagttatttcgggataagttatcctactatgtatatgagcttaacttatcttattactatggttgaaatctttaaggactacataatatctccagttaaacgcaggataatataattttgcttttatttcggaattttcataccttatatctcacatcaaatgacacgtaagtatttatattgagttgtaggagtaaccacctccccaaccccacctcacccccacccaacccaacaaatcaaaacgcaaattgtataacctaaggaccattaaaaagggataatgcttcttatcattattaatttcataattagatatcagactcgagacgtttaactaaagatcgagtgtttcttagttttattcgaaaatgacattttttaaaaatgggtaatgacataatgtatagttgttttctttgataaaagataatccattttgataccacaaatatttgacaactaagagcttttagataatttttgtcaaagttgtggccttaagcaaaacctaatattaggtatatatgatatatatttttggcttgtttcagatatttcgattcaattcaacactcaaatatacttcaaatgagcttaagtttgaaacatatatcataataagaaacaaattttaaatttagcctcttgttatatgagtgtcagtaa

SEQ ID NO: 408 - DNA, 3708 bp, Solanum lycopersicum
taaatagaatattacaattaaaatttttaaatacacaattattttataaaaatccactattcaacaattgtaataacgagggaaaaggtctgaaaaatacttcaattttgatcgaaattgctatttcgatatgaaactttatggagaaccttttaaccttccccactcctccaaactatttaatagtgtattttaaaggtatatttatgtccacgtagacacattactatttataattatgtaatatttttatgtccacgtaaatacatatatacctttaaaatacactattaaataatgtaggggtaaaatgtcttttctaaaatttgatactacaacaataatatcaatcaaagttcaaatgtatttcacatcattttccctaataactgattattatttaatataattattctacatgtaaccgacaatatctcacaacaaacatatatatatatattcaaaattttaaattcggatgattagtcatttattttaatttgtactactactatagtttgcagaaaagcaataaacccttttcttttttttttcttctaaccctagagtggtccttgtgaggttaacagtgtaccttcctttcttagcatcattaaatagaatcaaaacttaaaattaaaatatgaaactactacaataactagcttcttgactaatagactgttaaaaaaaaaaaactattcatgatggagtagtctaaatacgagaaattaaatttctattacattattatttgtagcctatggacaaagaattatcgcgattatatatacaaatactataaaagtttatatacacagtagatacatgatactgaaaactttacatgtttctcaaccctagaattgaattacacacgagtaagcgccacgtggccttctactttcctcttttgagataatattataacatagtgagaatctaacattgcttctttttctacaaaccataacttatccttgtaaatttattctctcttgtttctcttttggtcaaattttgtccataaactcattttttcccccaagccttgggagaaattattataaaagaagttaaatgttatcaagagttgttaattccatgttgagattttgctagccactcaaagatatatatacaagttgtagtttatcttctacaaaacctaattatgtaagtacaattcatgattcttatagtagtaattgtttatacaaaattttaaacatctatttttttagatcttagtcatttttacaaagtcttgggtgtttagtgaaatgattttggaggttaccctaatattaatcacaactccaattttcccccaaaaattgcactatgtacacaagaaaatttccattgatggagttttttttttttgtgtgtatagtataatttgataatattttatctcgatctaatagatgcttaatatttttctttgatttttactagatcgatgctgatgaagaacgatatatgatatacatatcatgaattcatcgagtggaaataattttgagacgaaacaagaatcaaataatgatagtagattggcctcaaagacgactagtgcaccaccatcgagtacttcaaggcaatggggagctaataaaaacccaagaatagtacgcgtatcgcgtacttttggagggaaagataggcatagtaaggtgtgcaccataagggggcttagagatcgaagaattagactatcagttccaactgcaattcaattgtatgatctacaagacaggcttggcctgagccaacctagtaaagttgtagattggctcttagaagcgactaaacttgatatcgatactcttcctccacttcctgtaccacctgagtacttcactcggtttcaacaaccatctcatgaagagttctctgatgtccgtgctcaatggttgaacgcgaacacatcttatttggaacatgggaggaacaagtcaatcgcttcaaatgaggaatcaaatcaagaggataatatgtttaccttaggaaatcaacgatcatctaatttaccaggcatgcctttcaattcttataactatcaatgggatcatcagcctaattcgaatttgtctttaggtcattttggacataatcattcattttcatcccaaatagatgatgatcaatctcatcaaaatactagtttccctctatctttgggatcatcatcttcgccttttccctcgagttctcaattgtatttcaatccaataacaacaacatttcaacctatagttccatctcctaactatataacaaatcatcatcccattgagagtcatgatccaagggctaatatgaaccatttcaatttcttaagctcaactacttcacacaataatcaacttgtgatgccaactcttaatttgattagttcccaaatgaaaccctttagtctcaataatgatcctagatggatgagttccagagatgatgaagatgacgatgatgacgatgatgatgatgataatcaaccacatgaaggtcgcgcaatttgattctaagccaagtggaggaaatgaatcttcgtctttacttcaaatattttgaattaaagttgttgtcctggattataatcatgctacattattccttcttcacaggtacaacaaataattaaagtgaatcattctatttcttataccatataggtttataaagttttaatctctattctgaaatatacaaatattaatctgtagtttttttttttgggtgattcaagtggtataaatctacattattattggtattggattaacctttaatttatacaaattgaaagtgtgtttagcattaattttttcaattttgtttttcttggatttgcatcattaatatgtcatggtttaaccgaaatctcgatagtagaaactctaatcgaagcaaaggttgggtttattctcgactctcacaaccttaaggtaattgcaaatatgatgcaacagatctggaactatagttacgtagtcaagtcaatcagttgttgttggtatcttcttctcatttttctttatttcattatcagagctccgagaagtaagagataaagatgttgaagaatatagtgaaaaatccataataggatctaaccacaaagtatgaatgattttagccaataaaaatattttatagaaggtaaacgaaactattcaagttcaattttgtcatgtaaaattgatacataacatatcatgcttagctgtgtactaatgatagacgtaataactagtaatataattaattactccattaatttgttttaatctaactagaaaacaaaaagtttctttcatatctaattaggtttttagacgaattagttggaaaataagaggaagaaacttaaaagttttactcttttaagaatgagtcttaggtctcatttgttttcattaagattaagatgttagaatcttaatgcttgtctgaacattaaaatgtagtttctagatttgaacactaaatgattatttattttcaatatatgaatgtgcatgatattttttaaaaaaattaggaattaaatattatatcaaaaaaagttataatctaaaccaagaatacttcttctaaaaaattgtttcaagaataagattataactcatccctagaaaagacgatttatttgttttctcatgaaacaaagataacttttccaaagaagttttgacaacaaac

SEQ ID NO: 409 - DNA, 6162 bp, Solanum lycopersicum
aggtagagtcaataacattgctaaatatgtttgtcgtctgtcagttattcaactagacggattcatatcacgcgatacataatgttttattctcgacaatgattaaaatctctttctcaaagtcaagctacttcaaaagattaacattttagctgctaacgttattttactttttttattatataaattatatgtcaatgtcttgttttctttctttgagccttatcaataatcgaacttaaaatatatcaatcaaaagttatttaatgaataattaaataaaattaagaaaagggatatggaaaaaataaaacctcctccatgtataagcacatattcttttgctttttttctttcaaatttgaagctactattgtatttattattattatttattatatatgagaatagaaacaaactttttaaattattttaacaatttatttctaattattattttttaattccaactccaaaattaaagaaaaggaaagctagtggaatctgactctcatccttctcacctttaagctctctaatcctcagtctcatattttattgaccaatcacacctcaacacctctcttccccacgcgctttcccttacgtgcacatcacactcttttcttctgatgtgtagtcggaatcactaattaatactaattcaacaaaataaatgatgtattttttttttatatattcttattatcatgtgttttatgataatcggtcaattaaaggtatatatctcttctagtgtaagttaggacttatgacagaattttaatgtgccatgaaagtacgaaaactatttatcgtggttagaaaatatagatagtaatttaagatgcgttacgtgtaaggaactatgagatcactccaaaaacgtcgaccctcgtggcgcgtgcacaagtggagcttacactcgcgagtgggcgttacaaagaaattgtatacttcccttctactataaattcctctcttcgaaactttgaaaagcgaaaaaaaaaggaaaaacttcaaaacagcaaaaggaaaaaagggaaaaaaaaaagaaattctccggcggaaattaccggcgattgacgatggccttgcctgaaaatttaaccagagagcagtgtttgtacttggcgaagctagctgagcaagctgaacgatatgaggagatggtgaagttcatggacaagctcgtaatcgggtcgggttcatcggagttgacggtggaagagagaaatcttctttcggtggcgtataagaacgttatcggttcacttcgagcagcgtggaggattgtatcgtcaattgagcagaaggaggagggtaggaagaacgatgagcatgtggttctagtgaaggattacagatctaaagttgaatctgagcttagtgatgtttgtgctggaattctgaagattttggatcagtatttgattccttcagcttctgctggtgaatccaaggtgttttatttgaagatgaaaggggattattatcgttatttagctgaattcaaagttggaaatgaacgcaaggaagctgctgaggatactatgcttgcctacaaagctgctcaggtatatttattatttattattcgacgtaactggtaaagttgttatcatgtgatcacgaggttgatttagtgcagcggatttgttctttttgctcttaattttaaagtttaatctacagaaacatggacttgttatttactgttgtctttgtgtattagtgattgaaacattggaagtaaattgttttttgaacttctcgtattttgaatagtgatggaaaattgagtttgcgtgtagcttgaagattcgaactttaagcagtttgattttgactttttgtaatgtggatgtgcatgtattggtagtttgtgttatttttcttatttggaatattaaattgatgggaagttgtattagtcttcatacagcttgaaagttcaaagctttagcagtggattagacttttacttggttgaaattgtatgccttttgggttgactattgttgaggggaagtaaagtcaactgtggtgaacttacatggtcccgtcagtgcatacgccatgtataagcagagttttccttttagatgtcagtgcctgtagagaaaatgtgttagtgagtatataacattacaacctgaaacttgtggataaatttagtcaaatttttgactgataagttgggatgcgtgagtggtgggataaaactgagagtcaagtgatctaatttgttgcccagacaccaccgtcatcaaaaaaattagaaagtgatctattttgttcatctttatttgggctcacaggtttaatttcttgctattttgtctaatttgatattggagcatcgtggtaaacctcggtggtttgctcaaggaactgaacaattgtctgttttgtggttcttccatttgagtttataatctcagatatggttaggtggttagttgcatatatttgtaacgtctacaactacttttttctcagtaaccatatctgtaagaggggtcgctgctttccttttctaatgataaaacttcaaacaaggagctttctttgtaacacccaatttcccggtaagaaagggctcatctgcatctcgttttcgaagatatgaccttaatgtcaatatccttttgtcctacacaaggggattcacatctcactgcttgtttgagattgagatgagtgagtcactcttatcaactattccacttagccaattcaacttctcttcaacttgtggacaatattacaagtgtcccacttgcaacatttgattatttccgagcattaaatccatagcagacttcttgaacatttttccagcaccaaattcatcttttgagttttccaagcaaaaagatattctcagagttcttcagttatttgtgaggaaaaaacaaaaccattaggtactttgtcatcttttttttttttttttgagagatcatcttttattgttgggtctgtaagccagtaaaagggatacttttggtggaataaggaaatcatggagcttatcatttaagtatagctattctttggttgctttcattcatacctcttcatgtgtcaggcccaacttatattcgctgagatctgaagtaaacttttccagcctgtccttcctgtgctgctctctttgttgaacagacatgggagcccatgtatgaatctttcatctcccacattaatgaactgatatttggaattttcttgatttgtgtcttttccagtagcagagctgtttctgtcacctgcattaagtgaaagttggctgatactcttgttatttatttatttattcatttactgtgattgtgcttcaggacatcgctgttgcggagcttgccccaacacatccgatacgacttgggttggctctcaacttctcggtgttctactatgagattctgaatgcatcagaaaaagcatgcagcatggctaagcaggttagtttgttttccttgattccttctattgtgtgtttattatcttcttcctcccacagcaacgctattaatgatagtgtatcatactgtccctctgtctaaaatgatagttcataccttgtaccccagcttttcctgcgcattgcatgcatccccgcatatgtttacatttgatattttgctaatactcatttagaatcttggctagaaaagccgttcctgtaatatcagaaccaattaaagcactgaagctgaagatattaactctgatgtgctaaagtattcagaatttttcgtttttctttcatctactttctgggtcaggtctgatagtaaaagtatatgaggtacaactcttttggttggaaaagaaagaaacaaaagtttgttactgggaggtaaataaacctcatctaggaagaaatttgctcatgttgtcttacctagttgtgatattcaaatacttatatttgtgcattcatgctccacttggttaacagatgaagcagccaaccccttgatctaataatcttaattgtaataaggatttgtttgatgatatgttccatagctatggagcaaaaaatcaaagatcctctggtgtttctattgtgttgcagaagtgtgcatgtgaagagtttatggtttatggagtagtactcgatgttagggtcatctgggtgaaaatctagcaaatgcataatgatccccaagtatgctggaactatatagtgcatagagtattagatgctcaatctgggtggctgtgaatgtctcataatgagagtgaaaggatttctcacttttatgaggaattagatgctccattcactaaaatcaatgcttattattaggtcttctagttgtgaattggtaataaaaatgacttccctgattaaagaaaaacgacttctcaataaccacaaacaaaagcacatttttgggtgtttgtttaggtagtttgaaaaatttatgcacaaatttgtggcaactatttgaatttaattgatagatctttgaccatgtggttgtggacttgtggtaaaggagtactacatcaacaatgaatgcctaatttgatttaaggagttgtctcgactctcgactcttgagctgattcgtgattcatcaattgctttgttacaggcatttgaggaagctattgctgaactggacactttgggtgaggaatcctataaggatagcacacttatcatgcagttgttaagggacaatctcacgctctggacttccgatatgcaggtacttcattttattcattagcaaaatccgttacactattgcatgatatgttatatatttacccccttttggcccggttatggatgagcagtgatttaatctacgcctcttagatacaaaccccacctcatttgcccttagaagaaggaacctttcctctcctagttgattccgtcttgtttcatagtcgttttgcttataacattcgtatgttttggttaatgcaggagcagatggacgaggcttgacatgatagcgctcctccaggagggtgagttcaaatgtcacaacaacagtctgtaaaatctacctatgcaattgatagcttttgtaatttttatatgccctgcttactttgatgattttcttgttcaaacttccgtttgatacttcttatgattttaattttatttctttagcttcccttttcgttcactctcttatgtcttggagtatctccaagtctgaaacccttctaattatgcgtctttagtttgactgaatatgaagtttaagaaagtaaaaaagaatgattgaatcttgtcatctttttaagttaatagtgtattatatacttgaaatatcatttaaaaatcttgtgtcttaaatgtgtcaatattctatcatagtcatggatttggtagttttctctttaactaaaacaagtgaattgtgttgtcattagaaatttcgggttgaagtcttgggagtggagtctgcctttgcttatgacatcaaaagtgaattcagattaatcgaattttaaagaggaatatcaaatataggaacaaaaaactcaaaatgtgtgataaaaatatatgattatctctaatttgaatactaaaaagacatcaacaagaaggtttataaactattattattattaatagaagaggtaagttatccacaaataaaattaaaatgtggagtactaaatgaagatagaataatattttttttctctaaaacaaaaatacttttcttttgttggtgatgtggtgtgggggaattgatattggaaaatgacaaatgtaagcaaaagtgggccattagaggtttgagaagagagaataaatataggcccatttgcataaatgttggttgggcaattaaaaccaaaaaactcaaattccaagaaagtcataaatgtttcttctactaaaaactcacaaagaaacaaataattgaaaccaatgtggacaaagactactgttccttcaagaaagttaaaagctaacagtactatggatactccctccgtttcatattatttgatccttattaatttgacagaattcatctaaaaaagcttgtattaggggtgtaattcactaattactaatgatatttagagtgttgcttcatgtagttatttgattctaatgatagaaaaggaagaaggtataacgcggttgcttgtctaaattgg

SEQ ID NO: 410 - DNA, 3586 bp, Solanum lycopersicum
cagaatcttaaatttcgtcataacaaatctaaattcttcttataagtttgttgttaagtaattgcgtaaagtaaattattttttaatgatataattataaagtgattagtttactttatgctattacttgattacaaacttgcacgaacgaatttagatttgttattctatgatccataaaaacggctaaattttctaatttagcaattggagagaaattcaaaaataacaacccatttaaataaaaatcaaaatttcaggtttaaactttaaactattaagccttgagtctatatttaagcttcgacataatccaaatatagaactgtttgtttggattgaagttttgatttttcatacttcagaccttccgatatccaattagggaaaattatgcacaattaacataccttcggcttatattaggtattataactgcagtttaaaaaaataatattaggtattatttgactgatttgtataaaaaagaatttgtaaagtttgattcttgattgtataaatgcagaaatttgaacatgcttaatctaactatctgtatacgatttatgaaaaaaaatcataataaattaccttttttgtatatcagcaagcgaaatatacaaatgtagttttaaaatattcctaaatgcatagatacaaaatttgtatatatttatcctatttgtatattcacaacagaaatatataaaccacaaccttcatagtaaaaaaatttataagcataaaacacaattatcgaaactatagctataaagccttattatgtttgttatttctacaattttcttcagagcaacatcaactaaattttaaatagactcagagcagctggtgctattattttaaagttgaaagtatgagtaatgtgaaggcccaaatgaggcaaagacctcagtccataaaggctcaaatggttccagcagcccggcccacatttacagacaaataaaagcaaaatggaaggtaaagaacttccaaaaccgctcattccattttctaaacttactctctctaaaacccctctttctctctctagaatacagaaccatcaatggcgtctccacgtgaagagaacgtgtacatggcgaagcttgctgagcaagctgaacgctatgaggagatggtagaattcatggagaaggtcgtcgcggccttgaacggtgaggaacttaccgtcgaggaacgcaaccttctctccgtcgcatacaaaaacgtgatcggagctaggagagcatcgtggcgtataatttcatcgatcgagcagaaagaggagagtcgtggtaacgaagatcacgttgcctccattaagaaatacagatctcagatcgagaatgagctgacttcgatctgtaacggcatcctcaagttgcttgattccaaactcatcgggtcagctgctaccggagactccaaggttttctatttgaaaatgaagggagattactaccggtacttggctgagttcaaaaccggaaccgagagaaaagaagctgcagagaatactctttcggcctacaagtctgctcaggtatttagactttcattctttataaaatgtggaggaaaatctcatatgagttctgcgaacgggaatgttctatgtgtgttaaattaggaaattgcataaacaagtactgcaagtcaccatttttatttagaagagtaaccaaaatccattagaattcgtcgtccaagggaaaaaatgtttcccgtggtgaaccatgtagtattatttaatcgaagcatgaacatgacgtctctctctttttcaggatatcgctaatggcgaattggccccaacacatccaatccgattgggtctagctctcaatttctcagtgttttactatgagatattgaattctcctgatcgtgcttgtaatctcgccaaacaggtaacaaatttattgtattccttgtttcttaattgagcatccagggtgattttggaaagaaaaatagatgtttgtgtctattcaatgatgtttatggtttgtatggttgtgtaataggcctttgatgaggcaattgcggagcttgacaccctgggagaggagtcctacaaggatagcactttgattatgcaacttctgcgtgataacctcactttgtggacctcggatatgcaggtaaatccttgtgttcttttgttaatttgattgttttgcttattagattgtttggctaatccatctcttgttgactttacttcttcaggatgatggaactgatgagatcaaagaaccatcaaaagctgataatgagtagtaacatcgtgagtgaaacttctttgcttagaattgacaaccgatgatgtaattttactcattgatcaaaattggctgtttgtagtccttatcctgtgatttgtaatacctattacctaaaggcgctgtttcttgccatttgttgttttcatcaaagattaccttttgtctacgtatttctcttgtatttggatgctctgatgaagctctcttatttcgtggaaatgaatatttattttcacgaagcaagtagtactttttatttcctttttctcgaagaagtagagcattgtggattgatcttccttcatattctgcattttgattgtctactccattttgttcacttggatatgtgtctattaattttgaatcaagtcaagattaaactttattgaaggcagtaagtacatatccatccatacctttagcttgggtttttaaagaagaatatgacttaatattccatctgttttaatagaggccctttttttggtaggcatttacaaagcatatgatagatctatgtttacctcagtagttagaggggtaaggtttctgtataaactgtgggattacgctactatgttgttgtttctgctgctgcagcaacatgatagatctatgtgacaattcttggaaatgacgtttgctctgtttctgagttggcaaatgttgtaactggttgttgacttttggtttcattttgtctaatttaaaaatgtattgccaagcatgatgtgcatactagaaccgtccttttttggtctataatgagtggcccgccatggtccatgctttcattgaataaagttctcactttggggcggcagcatctcattggctagctgtagtttaatcaagattctttgatgaaatttaggttggaatttcaaacttcaattactgtaaatattggtgataaattagtgctcttttgtctttaccctttagtaattatgaaactgtttccagccatcagtacacagaaaatttgactggctaaaggcaacataactttaactgatatgctaaagcattcttcttgatgattaaagctgacactggactctttttgttcccctttaccaattttcacagtttgattctcgagtcttgcaaaattattggtgctttggtgtacttttcattggatctgttacttattgctgatagtgcaacctaacattagtgttggggtctcaattgaacagattggtgacacaatgcgcctccgctctctccctttctttcagagttattactgggttacacgatgtgcttttagataagcgtgc

SEQ ID NO: 411 - DNA, 3528 bp, Solanum lycopersicum
tgttggaataatgtttagtcttttatgaacatatcgttattacacataaattatggtaaattttgttagcattatttgtatgtgaaaaattaaattagggcaactttcatacatagcaaacaaaaaatttatatttgtatgctataacaaactttgcacaattacactccatagcaaacataaaactgtataatttgctatacatatacaattgtataattcgctggcctaaattgtataattcgctagcctaaattgtataattcgctggcctatttcgctgaaattgtatgatttgttttgcatatagttgaatcgaattaaaatgtatgtatattgcataattataagtgtataacaagaagatatatgtttttctcgctttatacaataacagaaacacaatatatacacttttgttgtataaagctagagaaaattgtatttcactgcaattatataattcacaattgtataattcgttggcctttttctctgtaatatttgaagtaaaatgtttgtaaattgtataattaagtgtataacatgaagatatatatttttgcatgtgtgtatacaattttctctcgctttatacaaaacagaaacagaattatacacttctgtgtataaagagagagaggcgagcgagaatggagagtggcgagcgagattcttgggagagaaaattttagctaatgtttgctatggagcacaattaaattaaatcctagctattccatttaatttaggttattagtttgctattatatataattttcccattaaaatattatatataattatactcaataataattcatattcagctattcataaatttaaaaatattatattttaaaatattcgggcaacgtgttggtacatatatttaaaaaaattgaaaagtgcaagaaattgctgtgttattggaccactactaggcccacctaaataaccagtctataaaggaaacggcccactacccatttcgcactcacaaaaaatcaaattgtaggagaaaggaagctaaaaaccgctctcactttctctctctagaaaaacaaaaaactctctccctctttctctctctaacatcaatggcgtcgccacgcgaggaaaacgtgtacatggcgaagcttgccgagcaagctgagcgttacgaggagatggtagagttcatggaaaaagttgtcgctgccgccgatggtgcagaggagttaaccgttgaagaacgaaatctcctctccgttgcgtataagaatgtgatcggagcacggagagcttcatggaggatcatttcctccattgagcagaaagaggagagccgtggtaacgaagatcatgttgcttctattaaggaatacagatctaagatcgagtctgaacttacctcgatctgtaatggaattcttaagctgcttgattctaagctcattggctctgctgctaccggtgactctaaggtgttttacttgaaaatgaagggagattatcatcgttacttggctgagtttaagaccggtgctgagcgaaaagaagctgctgagaatactctctccgcttacaaagctgctcaggttagagttctcatttttgcttattgataaataaattattcgaattctgcaaaaaaatatttgcttaattgtcatgtttgatctcgtgctttcaggatattgcaaatgctgagcttgctcctacacatccaatccgattgggacttgctctcaatttctctgtgttttactacgagattttgaattctcctgatcgtgcctgtaatctcgccaaacaggtatgtgtttgattaactttttatcacaatgccgtagattatagtaggaatagctgctaattacgtgaatgtgccgagttatgttaatgaatgttaccataattagttgtaattagtactattagatacagttctgatgaaattgaatcagttgcatttgatataatgatagttgatcttattaaataatgatttatatggttgatttgatcatatgaaaggcctttgatgaggcaattgccgagttggacacattgggcgaagagtcctacaaggatagcactctgatcatgcagcttcttcgtgataacctcactttatggacctctgatatgcaggtacatatatatttctttctattgttaatacacttttttcgtgtttcatttgtaaaagatttttattgatcttgctttattcttgttcaggatgatggaactgatgagatcaaagaagctacacctaaaccagatgataatgaatgagcagcagtaaaaactggtgaaatttctttaggattgaaatatgctatgttgtaacttctttttcatttgtctggattcaactctttgttagttctagatcttgtgatttgtaatacctaaaatcaaccgtttcttgttaattgttgttcttgtttgtttctatgttgatttgctgttgtatttggattatttcctttttctcaaaggaatgacttactgggaagatggatgtaccttttaatccacaaatttgttagcttctccatttcatattacatggtcatagattcaaaaactttgtgccaaactaggcattgtctctagattgaagtttctgagcttctccattttatatttacatggatatatatatatgtccaaatactttgtgctggcattgggtcaagattgaagtttattaacttctccatttcatatttacatggatatatgttcaaagactttgtgtcaaactaggcacttggtcaagcttgaagtttcttagaaactcatttgtagtcttgcatctgaacgttgacctcaaactttcatctttcttttatttttaggtaggtatgatatctaagctaagcattatactgctctgtttctggattgttaaatgtttgtttgttgtatctccattccgaaatacttgtcatgtttttttttcgctagttaaactggattaggttaatatcttaaaatagggatattataaaactatcggttagtactataagttgctatgtttatattggttgtgaagtatattgtttgagttttgaaaagggaaaaatgactagtattttgagacaggaggagtaataaacaagagtcctccctgcttttgtttgtccatctgaaaatgacttgcatatggctattgacttggtcataaagtgtttgttctactaaatattagtactcacttttaattatgccagcaaggtgccactcactttgttcatttttctcacaaggagggacctactcttttcttttaattatattaaatttttagaaggggtggggtaactcattcatatcattaactagctgtctactttcttgtcgattctcttatgatgtcttggtttgaaatttgaaacctatctagtgctttatcctttagatattgctccttggtgaagaagctattgtataaattactcagatttggataaggccctttctttagtcatcataatcattagttttgtctgttcctcttttcaatatcac

SEQ ID NO: 412 - DNA, 5712 bp, Solanum lycopersicum
atttaatcgccggcaatttgagaaatccaaggtagttttaatcgcccactgttcccactaaaaccagtatcaaagtacatcccctttgaaaagcagttaccaaatgccgcataatttattttttcttactattaaaaaaagtgtttaattataaaaaaatatataatgtatattctcgtctaataggtagttgaattaatataattatataaagtaagtaaaataaatttaataatacatattcgttttgataatatatcataatttagacagttttatttgagattaatgtgtatatgatataactaaagaaataatatattttatatgaataatttaattatttaatattgcgttcagaattatttgttatgttgtgtttattaaaagtcaatttgattaatttttaaaggtaaattatatcacataaaaaaaattagatattctaaaactatatgaaaagtactataaattataattttttgcatattaatatgatgaaaaaatcatcttaaaatgttagtcaaaatttttatagtttaactctaaaaatagaaattataacaaacaatatcgaacggagggagtaattgaacaatactttcaaacttgtgtgttctagtttcacatttttgaatttgtgtttttcttattctttccagtagacagttaagtttagaaaatatatagtattatttaattatacatttgagttaataagtggtaaaattttaaatacttaaaggagatgatataatttttgggattagcttcagaatcaaatattaaagtgctaatacacgtgagttttgcttaaaaaacttagaatacaacatatttaagtgaaaaacttaattaggaattgaagtgttttgattaaaagattatagtaatattttagtaaagttaaaaagagggccttaatttagtcatttttttgtgtgttaaaagacaaataaaaggggggaaaagaatagtccaaagaaaaggtaaaagtcttcacatatagaagagaatcatcatataattcaattcaacgcagagaaaataggcagagagagagagaggagagaaatggagaaggaaagagaaaaacaggtttacttggctaggctggctgagcaagctgagagatatgatggtatatacatttttcattttaaatttctttaatttttgttgttgatgctactgtagaaatttagtatcagttctttgttttttctttgatttcaaaagggggtttattaatttgttttttggttgcaaaatctgggaaaaaaaatactgggtgttctttggttttgtctctagatggggtttagttaatttttttagttgcaaaaaaatcttgtttttttttcccttttgggatttcataaagttgtgatcttttttgctcatatgctttgtttctctattctggggtgcccctttagtatgtagttgctgattgttctgcaagattgtctttttttatcaaattagactggaaattgccttgaacagttcttgatgttctataaaagatgttttttttctttataaccatggtgtctagtcagtttgctggcatctcaactaatttaatggggtagtttatacgatccaccagcactgaacctggtaattctatctatgaagtttggactcataggaagaaatcacctagtgtttttgtctccgctaaatatggactgaattaaaaagccctttcgaggagaatgattttctctaggagtagtggttgcttcttgagatcaattgagagagtttttactaaggtgtagggaactattgatgaataattttggcttttatttgagatgatctctgagcacagatgtcaactaaagtggacttggaagaaaatcgtttgcctttataatttgttgtctaagttaatctagtttattacatagcaggacatgtatttgttaggttgtatgtagtactgcagtggaaaatactgtggaagctaatgtgaatgcactgttgttttgcgaaaaatggggtagtatatatgatgtagaaacacatcttatgattgatgtatggtaatataacaataggaaaagttttaagttaccagatgtcatgttgagagatgaaagtcattgtgattatgatcctaggatgaacattataacgtaaagtgatgagtggatatataacagatcatttggcttgatcccgttggttttagtctatcttatctaatctttcgtttagaggcgaaagaactattgtgtgtagagccaaataatatgaaggagagaagcttgaagctttcaaattgatgataagaagtgatgttgagcatacaggcaggcaatacaaatgagagaagacttgaagctttactattcatagttaatatgtttgtgcaatcttttacttactactactattcggttttcttaaagtttgataaatatgtgattatgcattatatttttgttgtcccagaaatggttgaagcaatgaaggcgattgctaagatggatgtcgaactgactgttgaagagaggaatttggtgtcggttgggtataagaatgtaatcggagcaagaagggcttcatggcggatcttgtcttcgattgaacagaaggaggagagtaagggtcatgagcagaatgttaagagaataaagacttacagacagagagttgaagacgagcttacaaaaatatgcagcgacattttgtcagtgatcgatgagcacctcgttccttcgtccactactggagaatctactgtcttctactacaagatgtaagttgctgaccttttttacttgttttcttctcttatttgtgacggagatgtatacatatttgctttctttgagaccctgttttaatttatttaggttggttgtttttcttcagttttatccccaaaaattgattgatgaacttacaagtgtacctccttttacttcacatccaggaagggagattactatcgctatttagcagagttcaaagcaggggatgatcgtaaagaggcgtctgaacagtctcttaaagcttatgaggtttcttttgttcaactgctttcaaatttgctcaaatgtttttctacgtctgtataaaagatctgcagcatttatttcctatatttgttgttcatgattgcacattattatattttctttggttttacgtcttgttcctaatttaagttattgctcaatttttgtaggctgctactgccactgctagttcagatcttgctccgactcatccaatcagacttggactcgcattgaatttctcagttttctactatgagattctgaattcacccgagaggttagataacaactgtatggacagaagctaaacatgttatgactagacaaaagatgttaacttaccattgtccatcaagtacaccccttgtttcatcttccccatttcataatgaaacgagcttggagattctaactggagaacttttgaaaatgattttctcatcaaactgtgaaattgtgaatcggggaagatgatattgagctgttgccttttctagtataattacacatagagttgaagagtagtgaggaatcaatcttgtgtaaagagcgtcaacggataattttggtagtctatgagtatttgacatattagccatcctgctttgaaatcttttcttctgagctgaaagtctattgggcgcaacctctctaccccacaaaggtaggggtaccccacttttaggactacactggatatgtcgttgttgttgtattgattatttgacatttcttctttttctttgtacatgtgagatcgtgccgtgcgaaggtaattaacctgtgatctggttttattaaggatacttcccgtacctaatttctttttcttttgtttaatccacctcctaccagggcatgccacttggctaagcaggcatttgatgaagctattgccgaacttgatagcctcagtgaagaatcctacaaggacagcacccttatcatgcagcttctaagggataatctcactttgtggacatcagatcttgaagagggaggtacgtacttcttatggagatgcttcaatgttttcttagttatttcgctttctcatggttgtggatgttcaaatgcctgctacatttggtaaataggaaaaagctgttgcttttgcaattagtttttgcctttttatgttgcatagctccataaagacaatttttgttgactgtaatatatattgatcctgacttaaaagggatatatgagagaagactaatttgaatccatagcaatgaataggaactattgtaatcaaacgttaataagtaaaatagttgccgattgaaatgacattgatatgtgatcattttgtcaggtgagcattctaagggtgatgagcgccagggagaggtatgatttttaactggttgttcgtcttcaatatcactgttatgttcttgttgaaatgatccatatacaactaggccggtcttgtcacgttaatcgccttcttctttttcatgtttacagaactagttgaagttcaagaggtgtcggtgaatcattgtgatgctggctcctcaagagacatgttagcttgtggaaagtctttgttttcatataatgttcagggattcatgcctattggctttgtactttcttcctccatatacataaacattcccagagtacttctcattttcagtaaaaaaaaaattgctgctattgttgcatcatgtgactgactgttctattcgaaatatagctagttgggtctaaacagttgcagaaatgcattgctatacgtcaatgaatcgtatagtagccagcattttcatgtcacagtgtggtggttgctttgaatggcctttcattttacgaaatcccagaaagaaatcgagatttgagagcaaccatggtagttgttaatagttaaaatgtttgtgctatctctgaatgagcaatacaagaataaaatagcaaaacatggagatgatacattatgataaatagatacatcatagtaggcagcaagtgaatcatgtttggtcctgagggggagcactttttgtggtacccaaaagaaatgctttcaaaggcttatgaaaatctcttggtttctcatagagaaaaccatggcctgcattcttaatgactaccatctgagcattttcccctaaatgcctgcccaaaaatattcacaaagtcagtcaccaagcatatgattctatcactatatatctgcgcatgatataatttatgtctatcgagctaggggatgtaaatattttgactagtgtatatcaaaatttcaactaacccagttggagaaatgaaccttttcaatctgtggcctagttctaatggaaatattttgtcttgatctccccacactattaatgttggctgcaaaataaagagcaatattaggaaaaatttcttgatcaatgtagtagaggattgtgggatattataataaacttaattatgtcccgcgaatattgttaaaagatggagagaaggaaaagggaaaaaaacctgagtgatcttaggtaaatcagaaagctttctgtctttagcaattgcaagaagcaattctttcttctcctctacatattgtgtaaacatttcctgctcatatataataacacccaaatattcattgactatttccattacaatatagaacagtaaaagaagaaacaaacaagggctttttatttaa

SEQ ID NO: 413 - DNA, 3297 bp, Solanum lycopersicum
tttacaaccataccaaacacaacctcattatacataaaacttaattataattatcatgatcatgattaacactaatgtaatgattcctttgtgtgctggaacgtcattttagttgttctaaacatgaaaataaaattgttcttgacaacagacatctagtattatacgttagtggagcttactttttcttctcttctttttttttttctttcttaattaaaatttttttttatcactttttaaatgttgtattggttgagcttatctaaaccaagtattttttgaatgttcattacaatgaaatattacttagggtctgtttggtaccaaaaatattttttcaattttcttttatatttattcgatcaaaattttatataacattttctctgcaaaacaaacttctttaaaatgaaaaagctgactttgaatatgagaaaaaaagagtttaacattttctctgcaaaacaaacttctttaaaatgaaaaaactgactttgaatatgagaaaaaaagagtttcctaattgacattccagtcctcaccatcccacacccagctctatagccccctactccacacacacaccccaatttttgtacaaaccctttatttaaaaataaactgaatatttataaaaaaaaaaattcattataaacagattattataaaatttaaaattctgaatcctcaaagtttaaccagattatgtaaaaataatattttctatttatttaccaaaacattaaaaatttgataaatattttctatcgtaccaaacacgccccgagacatctcaatgagaccatttatacgtactactataatgtaatgaatataaatcaaaaaaaagcgtatgggcggttgggcggcgccaatcatttgccggagtctactaaaaataggccccatggtcggcaaaacctaacaaattactactattatttttccaagtctactgtggatatataaagagagtttatgtgaaacaatgagaaccatcaagttttaagtgacttcaaaattgaacttttaatttaagtacattctttagtgagagcccaaaaaaagaaaaaaatggtgaagattgcctttggtagcattggtgactctttaagtgttgggtcattgaaggcttacttagctgagtttattgccactctactctttgtatttgctggtgttggatctgctatagcttttagtaagtcacattttcccaacgttatacacgttatttatttgtgcatatctataaaatgttattttcacgacttgaacgtgtgacaatttgatcacatggaaacgagacaatctttgtcataatatagagtattaatgtaatttttcctttttttgcagataagttgacttcaggtgcagctcttgatccagctggtctagtagcaatagctgtggctcatgcatttgcattgtttgttggggtttccatggcagctaacatctcaggtggacatttgaatccagctgtcactctgggattggctgttggtggaaacatcaccatcttgactggcttattctactgggttgctcaattacttggctccactgttgcttgcctcctccttaaatatgtcactaatggtttggtatgttgtttcactatgaacatactattgaattaattaaatagactctaatgggcgaccgcgaccgtgttgtactaggcttataagctgatcaaattaggactattcttttcagctacttataatctcctaaccaaacgggatcgttattggatttttgcaggctgttccaactcatggagttgctgctgggatgagtggagctgagggagtagttatggagatagtcatcacctttgcacttgtctacactgtttatgccacagcagcagatcccaaaaagggctcacttggaaccattgcacccattgcaattggttttattgttggtgccaacattttggcagctggcccattcagtggtggatctatgaacccagcacgatcatttgggccagctgtcgttgctggagacttttctcagaactggatttactgggtcggaccactcattggtggaggattggctgggtttatttatggagatgtctttattggatgccacacaccacttccaacctcagaagactatgcttagaacaaagaagaaagaacaagtcttcaacagtgttttctttcgtgtgttttcaaaaatgcaatgttgattttaatttaagctttgtatattctgttacgcaagaagtttgtttccaatgaaatatcatgtttggttcattttgacaacggatggttttgaagttttgaccttgcttgcctcgtgtgtgaaacttaccatagtttgaaaaattgaaatgttaaaactaaagtcattcacccaacaacttaaactgaaaatagccagaattggtataatatatgtataactcatgtacaatatgtgtgtaattgaaatattaaaactaaagtcattcacccaacaacttaaactgaaaatagtcagaattggtataatatatgtataactcatgtacaatatgtgtataatctttgtataccatctaggaaaagcaaacaatgagtctgaccaactatttatgtaaaggtctaaaaagtttgttgaattggtacaaaccagtcaattcttcagttttgcttaataatgtgttgtacaaattagttgtataatcgtatactagtttcacaagactaacatacaactttcctgtatgacagactaaatttagagagaattatgttgaataccctcgttctctcttcagttatacttaaaatacaacagtcttttctttctcatatggtaaaacacgtagttcgcaatatgatttaatcgcttttactagacactgtttctcaagatcctcagacttctgaataaagctttgcaaattatctctgtgggtaactctttcaacctgaaagaagataggtttaatttgtataagcctgatgttgaaattctaaaatgatggtaaacatagatcagatgatacatggatctcttagggggcgattcactaagatggtgttagctttaatcaacagaaacagctacggtgttaccatcagaacataggttgggtaatataaggtagcatcgaagcattcgagttattaacaagatccaaactaatggctttaagggatctatgattatgattgatcgctatgaagatgcagatcttagaggaggttcttgtgggaatcctgctaaaccatacaacttattctagaccatgaaagaacaagttggagcatgacatga

SEQ ID NO: 414 - DNA, 5191 bp, Solanum lycopersicum
  modified_base (4204)..(5191): a, c, t, g, unknown or other
taagttaacggagtggagatttttaaaagatgatagttaaaatttgcacataaccgaacaaattgtctatttaggtatgtaatttagagagtgtctcttttgaggtttgatgtttagggttcaaaaattgtccgttttggtgccagaaacgtgcctacaaccaccatccaatccattctcaatcacaatcaccatcactgacacccaatcactacaataagtcgtcattgccgccatccttataacaaaagtaatttttttgcagtcataactatatactttaataaaaaaatgtaaatttttatcgacattacttaagtatcattaaatttactatcgctaaaatctttagggaaatttataaagagtgttaattgttattaaaaaaattatatttatcgataattaaattattgttgctaattacttaccattgacgaccattttcaatgtagtacatccaatattatcgcaataaatcattatcacccgtcattactattaattactacttatatatcgtcaatcaccatcatcattaaccattgctcttcatccaccatagttattgtctttcaagcattaccatcattcatcatcattattaactacttatatatcatcaataacgatttatcattcatcacaattattatttatcaacatcacctatcgctcttgatcattactattaatcatcattaacctttaactgcaacttacactattgttcttaatcgatattcacaatcaccatagttagtcatcaccatgagtcctagccacaaattcaaagcaaaacacccttaaagcctggtagtgtgtgtgaattaaagaccagcagtccaaagagagagagagagagagaaaatgtagactttaaagatatgtagtaggaccagtctgccattaatatctccttctaccaaccttcctctcctctttcactaccctacatttaacattttcctataaccactgctttagataagtcaaatttagctctttgttttgatctctgtttcaaaagaaaacacctattaagcagccatcatctttcttatcttttccaaaaccaaaactactgacttttcttgaaaaaagaagaggtggggtgctttcttttcttcaaaaaccttctctttgttcttgaaaaaacaggactcattcatttttttttgtgtgtttctttcagaagaaataacaaagaccctttctctgttttcttcatatttcagctttgagctacttggatctgttttttttttttgaatatacaagtagtttgtgtgttctggggtctacagaagaaggagaagctaaaaggggtgattttgttttttgtttgttgttgttctaatggggatatgtttgagtgctagaattaaagctgaaagcccatttcatacaggtatttgatataagactatgaactcttttttttcttcttgtttacttgcacaatttttgcaaatttgagtctttttggaggaggggttctgtagaatggttttgtttgtttgttttctaattttcattcatattaggatgatcatgcctttgttcatgtaaagtggctagtttgagttcttgctaattttttagtagtctctatttggtaatagtagttatcctgattaatatatcttgttgataaaaaaaaattgggggtaggggtagcaaaggggattataagttagttaattgagctactaagatttaagatgttttgttgtgttctaatggggttaattgatggtaatctaataaattgagagaattattgcagggctaaattcaagatctgttagcatagatggtggtgatagtaattcaagctccagggttccatcaactactagaagtgaaggagagatattgcagtctcccaatttgaagagctttagtttttctgatctcagaacagccactaggaactttcgtcccgatagtgtgctgggagaaggtggatttggatcagtttttaaagggtggatcgatgagaacacgttcgcagctaccaagcctgggacaggtgtgatcattgctgtgaaaaggcttaatcaagaaggttttcaaggtcacagggaatggctggtgagttttttttttatgtttgatatggagatgttcgagtcggtttaagcttaaagtgcattgattataccatgaactcagagtaagcggaactagatcatttgctattggtttggacgaagccagtagcttttgcttagtccctgtatttgtattaggaaattcattaaatatgtatgaaacgttttattgcgaaacctactaaagaagatgaattatgagatttgaggcaagttcagaacccataaacttcaaatcttgattctgcctctacaagaattgtcgttgttacttattgagtgctttattaagtgctaatactttgttattttgagtgtcataaggttgtctgagttctgatttgtattatgcttctatgtttttaggcagaagttaactatttggggcagttttctcatcctcatcttgtaaagctgattggctactgcttggaggacgaacatcgtcttttggtttatgagttcatgcctcggggcagcttggaaaaccatttgtttaggagtgagtactttgcccctaccatcttaatttcaactctatgatcatcgacacctttggagtaatagtgtttgttgttctgtaacaggaggttcttatttccagcctctttcttggaaactacgcttgaaggttgctctaggagctgcaaaagggcttgcttttctccacagtgctgagactaaagtgatatatcgagacttcaaaacctcgaatattttgcttgattcggtatgtgtcccctatgaattagatctttgtgcaattgcttgcttattacgaaccagctaacgtgtgcttacttggtgctgtttctcttttatcgttatagaactacactgccaaactctcagactttggattagccaaggatgggccaacaggcgataaaagccatgtctctacaagggttatggggacctatggatatgccgctccagaatacatggctactggtatggtttcttttcccccctgactcatgtgttagttttctctcttgttccaacgtggcccgacatccatagagtatccaaatttagaatattaggtactgatcaggacatctttacgtctaagatggaacattttttcttatccaagatccatctaacatgcagttttctcttttctttttaactcgcattcttattgtcaagaacctcattagtcattcacctatgatgcatttgtactgcactccatcccctgggcaacaattagttactgctctttctgggatggactttgatatcttcatgttgagtctttaatcagccgatacaaacttgtactcttgccgacttcccctgttgcgttcaaccgttgtcataatttacttgtaccttgaattatctattaataactcaactccctttgatccatctgtttgatacaggtcatttaactagcaagagtgatgtgtatagttttggagttgtcctccttgaaatgctgtcaggtcgtagggcaatcgacaagaatagaccatccggagaacacaatctagtggagtgggcgaaaccttacctaggtaacaaacgtaaggtcttccgtgttctggatacccgtcttgaaggccagtattcaatggaggtggcgagtaaagtagctaaccttgccctgcggtgcctatccaaagatcctcggtttagaccaagcatgagtgacattgttaaagaactggagcaactttatcaacaatctaaagattcaggaaatactcgcagccacgctagcaaccgacctagaccacgtagacgaagtgctggtgatgttgctaatagaaatccttcagttgcttatccgagaccgtctgcttctcccctttacgctaaataattaaacaaatgattgaaagatgccttaatttcttgttttttttgtcttatatgtgtttatcaagcttgataagtagttgaggctgatgaagaacctctgcacatttgcagtatcagctggctgattgtacagttgtttttggctaatgtattgaatctatactttctgtaggtcctgaatgtgtttgtaactttgagttttgctcacagctcactatatgttcactttttgacactaaaggaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 415 - DNA, 5382 bp, Solanum lycopersicum
ggccataaatgaggtaattaattttcatcatatttataaaaatatctcctttcacacttgaaagtgatcatttagttgactgttgatagaacataagccttacccagaaaatgacagattgttgatgatcaaatacactaaattacattatagtagttatgtaaaatatcgtactaaacacaacattaattaaaagtagaaaaaaagagtggaataacaagcactcgagtagaaaaataaatcatccttcctataagtgttttgctatccggttaaataaatatatatgtatattaatttatgaaccaccaataaaattgattgttggcttaatggtaagtaaggacccttataaatgcttcccacaccagtgttttaaaaaaaggaaacatgttttgcaatatttttctctttctatcctaaagttagaattctcaaacaacttctgtagttacaattacaacctttcggaaatatccaataaaattgaaacgatacacaaaagattagcatgacctttactcaaagatgacgacatatacaaattgagaaatgattaaacagagaaattaaaacaaagaagaaagaaataagcctactatttttctacacggttgaatgttcttcttcttctaattttttcttgtggaatttctacatcttttttttttaaatttttggtctccaactaaaccagccccagtttggctagtgctattttttttttgttgactctagtggaagtctcctaaatttttctcttcctctggtcttttggtagattcaagtttttaaaaagtcagaaatgtatcacagtagtacttagatatgaaaattctaaccatacaattccaatcatattaacaatttcataaatgaagcaagaccaaagaggagacttcaaagtcttccacagaatgaaccaaaagggctaacaacaaacaagtttttaagttccttcgaactgcataactgagtcatattcaagctaacaagttgcatgaaaatgatggcaactctgtacttcctatggcttctcttgattccctcgtttcaaatcttatcaggataccacattttcttggtttcctctcaatgccttgacgatcaaaagtcattgttgctgcagtttaagggaagcctccaatatgattctactttgtcaaagaaattggcaaaatggaacgacatgacaagtgaatgttgcaattggaatggggttacatgcaatctctttggtcatgtgatcgctttggaactggatgatgagactatttctagtggaattgagaattctagtgcacttttcagtcttcaatatcttgagagcctaaatttggctgacaacatgttcaatgttggcataccagttggtatagccaacctcacaaacttgaagtacctgaatttatccaatgctggttttgtcgggcaaattcctataacattatcaagattaacaaggctagttactcttgatctctcaactattctccctttttttgatcagccacttaaacttgagaatcccaatttgagtcatttcattgagaactcaacagagcttagagagctttaccttgatggggttgatctttcgtctcagaggactgagtggtgtcaatctttatctttacatttgcctaacttgaccgttttgagcttgcgtgattgtcaaatttcaggccctttggatgaatcactttctaagcttcactttctctcttttgtccaacttgaccagaacaatctctctagcacagttcctgaatattttgccaatttctcgaacttgactacattgaccctgggctcttgtaatctacagggaacatttcctgaaagaatctttcaggtatcagttttagagagtttggacttgtcaattaacaagttgcttcgtggtagtattccaatttttttccgaaatggatctctgaggaggatatcactaagctacaccaacttttccggttcattaccagagtccatttcgaaccatcaaaatctatccaggttagagctttctaattgcaatttctatggatcaataccttccacaatggcaaaccttagaaatcttggttatttggatttctccttcaacaatttcactggttctatcccatattttcgactgtccaagaaactcacctacttagacctttcacgtaatggtctaactggtctcttgtctagagctcattttgaaggactctcagagcttgtccacattaatttagggaacaatttactcagcgggagccttcctgcatatatatttgagctcccctcgttgcagcagctttttctttacagaaatcaatttgttggccaagtcgacgaatttcgcaatgcatcctcctctccgttggatacagttgacttgacaaacaaccacctgaatggatcgattccgaagtccatgtttgaaattgaaaggcttaaggtgctctcactttcttccaacttctttagagggacagtgccccttgacctcattgggaggctgagcaacctttcaagactggagctttcttacaataacttgactgttgatgcaagtagcagcaattcaacctctttcacatttccccagttgaacatattgaaattagcgtcttgtcggctgcaaaagttccccgatctcaagaatcagtcatggatgatgcacttagacctttcagacaaccaaatattgggggcaataccaaattggatctggggaattggtggtggaggtctcacccacctgaatctttcattcaatcagctggagtacgtggaacagccttacactgcttccagcaatcttgtagtccttgatttgcattccaaccgtttaaaaggtgacttactaataccaccttgcactgccatctatgtggactactctagcaataatttaaacaattccatcccaacagatattggaaagtctcttggttttgcctcctttttctcggtagcaaacaatggcattactggaataattcctgaatccatatgcaactgcagctaccttcaagttcttgatttctctaacaatgccttgagtggaacaataccaccatgtctactggaatatagtacaaaacttggagtgctgaatcttgggaacaataaactcaatggtgttataccagattcattttcaattggttgtgctctacaaacattagacctcagtgcgaataacttacaaggcaggctgccaaaatcgattgtgaattgtaagttgttggaggtcctgaatgttggaaataacagacttgttgatcatttcccatgcatgttgaggaactcaaacagtctgagggtcctagtcttgcgctccaataaattctatggaaatcttatgtgtgatgtaaccagaaatagctggcagaatctccagatcatagatatagcttccaacaacttcactggtgtgttgaatgcagaattcttttcaaattggagaggaatgatggttgcagatgattacgtggagacaggacgcaatcatatccagtatgagttcttacaactaagtaaattgtactatcaggacacagtgacattaaccatcaaaggcatggagctggagcttgtgaagattctcagggtcttcacatctattgatttctcttccaatagatttcaaggagcgataccagatgctatcgggaatctcagctcactttatgttctgaatctgtcacacaatgcccttgagggaccaatcccaaaatcgattgggaagctacaaatgcttgaatcactagacctgtcaacaaaccacctgtccggggagatcccatcagagcttgcaagtctcacattcttagcagctttgaacttatcgttcaacaaattgtttggcaaaattccatcaactaatcagtttcaaacattctcagcagattcctttgaaggaaacagtggcctatgcgggctccctctcaacaacagttgtcaaagcaatggctcagcctcagagtccctgcctccaccaactccgctaccagactcagatgatgaatgggagttcatttttgcagcagttggatacatagtaggggcagcaaatactatttcagttgtgtggttttacaagccagtgaagaaatggtttgataagcatatggagaaatgcttgctttggttttcaagaaagtgattattaaacccataaataatgagtttattcttggagtgttttgttttaaataaacaacaggataaggaaaatcaagttaataagctcgcagaacatgattgttatttcctttgatgaatgtatacaattttcaatattggttcttcaaccataaccgcaggctaactgtcagttgttggaagtcctgaattttggaaatgacatacatttttatagtttccccttcatgttgaacaaaatgcatccagtcttagactgctgaagtattgcgctacaacggattttatggagattgtcagtgtgatccaaccaacatagctggaaaaatctccagatcatagttatagtcaggggcggagctagttaagaaaatcattagaaatattagatttagaagcataaaattggaaaggttgcagtttactgctgttgccatcaactcagatgatggcttggattgcattgttgtaaaaacaaccctgaatgtggagttttattcgtaaacaaatgaaaagtacacacaaacacttgattcaaaataaatgtactcggctaggatcattttttatttattcatttattcttatatttatttatatatattatttttacactaaataatattttcgtaatctaagataaaatctcaaaggcatgggatgttttgttaataattcgtcaagattttttatattttactgcaacatttcttttcctattatttcattcaattttgtgttcttatgtgtagttttgaataatgaaaccaatttcacaatttttgcttatgtttacttttaagaataatttaactaaaatatatttaaaattgaaaaagtattatttagtgtaaaaatattttttttaaagaaataacaagaaaaataatcttgattattcatattcacaccattgaaaagtaatgaataaaatagtaatgaagtaaatcaatttgtgtttcatattatatatttccttttttacctcattacaaaagaaagttactttagaataatttaattttaaaatatttattttattgttattaaaataatttttaataacataaatatttttttttttaaaaatattttatactataaattttagaagtattcaattctttttaacatcctatcaaatcgatgtcaattttatggaaaaatattttccattataccaaacataccccccattgtcatttttgttttcttttttaa

SEQ ID NO: 416 - DNA, 6739 bp, Solanum lycopersicum; identical to SEQ ID NO: 267

SEQ ID NO: 417 - DNA, 4187 bp, Solanum lycopersicum
ttttctcctttaaaatgccttttttctatgaaaagcaattaggcaaacaaattcttatcttaatcatgctatttacgcgctcaattattgttagcgatcgactttgtttgtgcttctgaatgtgacattttgtacctaaaaatggaatctcctctttaatcaataactaaatctatatcaatatcaatatttatattcatttgtctgtttattctatgctattttaaaagaataaactttctaattcgatcattaaattaaattattataatactttcaactatttcgaagaatgataatttttctgatgagttgtgatttttttttaatggattatgaattttttattagttgggatttttccgaaaggttataacttttcaaaaagatgtaataaacattcgctcgtactatcctttattagctaaagagggtttcattttttaactataaattttttaaaaaaaaattctactctcttcttcttaaatatcaaaactcaaatatgattaataattattagagtaaattcaaaattcatcgaaatttgagatatgacttatcttttttgacatacacgtaaaagaatattttaacgcgattataaattaagcataagtatacaaatgcgacgcgtgtaactaaaactagtgaaaataataaaggccacataatcttttgatttggactagtttatattagaacttggaaaacacttaaaactttaacatcaattattgatgaaagaataataagtttaacgagtaaaagaagaagaagaaaaaacgatacgtaaagcgtggtggcccaaaaaacgcactctttgaattagtcattgtagggtctctatttaatttaatttctctctagtaaagggggaaaaaaaaattcaattcataaaacaaaagaaaagaaaattccaacaaaactataatgtataatctcatagtcaatatttgttcccctttccactttttttcctctttatatcccttccatttccttcattttttttcttctaactatccctaaagcaacttcacttgctctctcctacttctttcttagcaactttcccccttcataaatccatttatatgctcacacacacacatatttcacaaaattaattaccaattttgtcatcattgaagtttcacaaaatggagaaagttaaaagtatggagaaaaagaaattgattaatgagttaacacaagggaaggaatttgtaaaccaattgaaaaatcagataattggtccattagcttctcctgaggaatgtgatttactaattgggaaaatattgtctacacttgaaaaatcattatcaattctcaatttgaaggctcttcttcttgaaggtggaattaataatattaacaattctacatcttcatgttcatcgatttcatttcttggtagtagtaataataatattagtcccaagagtgaagtttttgattcttcaagggaaaaattggacaaaaatatggtctccaagaaaaggtgatttttttttttactattttggactattttcttggatttttaaaaatatatatacatgtttttgctcaatttgtatatatatattttttggatttgcagaaagaaaacacaacaatggattaatcaaacaagcatttctgtaaatgggcttgaaggtccatgtgaagatggatttagttggagaaaatatggccaaaaagatattttaggggctagtcatccaaggtaaaaaaaataaaaatcctttaattttactgtttgttaaatttttttaatctatttgtttaatggttaaatttaattttgaataaaaaagacaagattatactaaaaatggaagtgatttggactttttttttgtctcgtagactaactacttaatcaactgttgaattaattaatgtaattaacttaaactaagatttattacttgttaggaggtggtcagctacattaattgcaattgcccacttgctccaaatataaattacaatgaaaatgatggcagtagatgggatccttgaatcataaaaaataaaaaatagtagtaaaaagttaaagataaaaaaataaaaaataaaaacatcatagttcctagtttttggtgtttttaggctacattcagtgcatgaattttgatcatttcatgtggtcccttctatattaaaacacttccaaatgtctcttgtccttgagtagctagagaaagtaaaccaatcaactttttgagtcataaaggccctttacttttggcaagtagtaatgtgaaaaaaaataattgagatcgtaaatgatagaagtacatcgaatcgagttttaacttatatacaatgacaacagtttcatactggttgtttaaatttaacatgttgtgataagtcgatatgtttgtgttaatcatttttctttttgggggtaaatgcagggcttattataggtgtactcataggaacacacaggggtgtttggctacaaaacaagtccaaaaatcagatgcaaattcaacaatttttgaagtgacatataaaggaaggcacagttgcaaagttgcacaatctgaaatattttcacttaataaccaaaaacgccagaaatgcaacaaaaaacaacaagaagaaatggtaatattcaactctgcaacaccaaaccataacgctgaaaactttaacattataacagcaaaagatgaagaggttttcacggcgttcccattccctcctgcaccactacacatcgaaaatattatcgaagaaaataaattctttccagattcgtcagagttaccattatacttggcgtccccaaatgatgaatttggaatggaacacatgattctacagagctcagattcagatcttactgaattgatatcaactccgacttcgatttcaaattcctcatttggtggagaaggggtggattatgaacctgaaatcacatttgacattgaagaattcttcatttaatttgaaatttagagaattcattgcaagtttgtaatagcaggaagtaagttttgtgcaataatttttgttgttatttttagcctaattgatcctaagctaaagtcaattgactgatgtttaagagaaatagttgtagtaaaattgtaacgtcgatgaattcatgtttgtaattacaagctttcgctattgaaattcaagttgcatttcaatttttttgtttgttttagtaaatgagattaatttaggacaaaagtacgtaattacttgagcttttataaatttaaagacaagttatgtaatagtaacacttggaattacgtgtatcaaaatgattatactgaatcaatatgtatatgtatatgatatgtgtttgtattttgcacgtacaacttatatctcatataaatcatttaactatttttcatagtgagttggaattcgttcagtgattcggctggttgaaatattcttcttctagaaaaataaattttgcattttagtgccaaaggtattttgtgaatatttataaaattgaataaattattaattttatatatatatatatatatatatatattgttttattttattttattttttaagaaaagatatttaaggaatttttctttaaataaagtaaattatagggataatgcacaactacccctcaacctatgtccgaaatctcagagacacacttatactatactaagttatattaccctgaacttattttattaataattttctatcccttttaggcctaagtgacactatcttgtgggcccaatgttggttgattttttttttcaaactagtgtcacgtaggccgaaaaggaataaaaaattacttatataataagttcaggaagcaataataccttagtataatataagtatatctttgagatttagaaaataaattaatgagatatttgtacatattccctaaattagaagaaaaacaactaagaaattaaaaactagctaggcaagagttggatggattagattctgaccaattatttaaggaaaaattacataaattaatacattttaaaaaataattactgattttagcgatactttttgtttattaacatttatagcaatactttgttaaatctgtaatatgaattaaaagtgaattatgtacgcaatatatatgaattataattgttttttgaaatatatcatgtttgtttggtaaa

SEQ ID NO: 418 - DNA, 6160 bp, Solanum lycopersicum
aaatatatcctcgaactatcgttaatagtatgtatatatacttcattgtacttttgggacattggtgctcctaccgtccaaaaactggagcatattcgtagataaatgtcggatcagtggataagattatgacacgtgtatgtccgttaatataaagggtatatatgctttaatttttagacgacaggagcaacgatgtcccaaaaatataatgaagggtatttgcatatcatttacgatagttcggagttatatttgttctttttccattctcgttattgtaatagtatttagaaattacataggttttttttaatcgcgcttcaaattcttccctttttttaccctagagtactctatcatatcgaaacaaatctagattctatcccacaaaaaaaaaagacaaaggatagcgggtgccctaggtcgtaagttattagatttgcctgttgaaagatccaaaagtggactcatcaattactggcaattgacccaaaaggtagcagctgagtctattaacttatgaaagacaaattcctatatataatggctaatatataacctgtttgactggccatgtgacttcccttcaacaatattattattattattattagctgttgcaactagcagcccaaacacggtatggatcggtgacccgacccttacggagtaaaatcctctttctatcatttatataaattattaaaaaactttgaagatttcttcttcaaccattttttaaaaatgttttttttctatattagaaaagaaaaaaactaattaaatatgcatatattcctaagttgtgtgcaactgggccattgacatttttttgttttgtttgtggtgtttgaaatttaattattttggacaagtcaaatactgttggcttagccttataaatgagaccataaaattgctttttcagatatagctaaaggtatagaactcaaagaaaatagagaagaaagaaaaagataaaagcttgtgtatgcatatggagactgttttcagaaaatcaactcatggaggtgtagtcaaacaggacataaagattaaagctagtgaagaaggttttgttgaagatataaatgatcttaaggtaataatttaatttctctctataatcctctagatattttgttattttttatttggattttagtgcataatgcttttattagttatagaaaaaatatttgcatggtttcggaattatgttgaaactattaaatcttagctcgatagggtaaagataaaatttctatagtatttcaaaaatctatattttgcatgagaattggaaacaacttcaaacaagtctagtaccacttgatacctagacgtgaattggaaaagattcaaaacactaactatatatatacctataatatcttttgaatgaactaacagtgtaaaatagatgacgaatataatttataaaacttaaaggcgagattaaattaagctcagtgctctaaattaaatcagttaataacatcctattagatctcacaagatgatctattatgcttcaatatattcaggttgaaaaggagagaaaatcaatacataacgaggacgataattcgaagtcctctcagcaaaaggatctcactggggacaaaaaggtataattatctccttgaatctcattgatttgcttgagtttgatctgttcatgatatttggctaatcatgtatgattagtttctatgtaatttgtgtgacttgttaaattttataacactagttttagttataaatagcttgtaggagggtaattagttaaagggtaattaattatatccagccagatctctttaaaatataactattagtgcaaaatcttgatatgatatggaagcagatcaggaagatgatttagagtacaaacatatgatgagttcgttaaaacctaatatactaataaattcacgtatttgattgtgaactgctttatattttattgtactctctccgtccaaaattatttgtcatggtttctatttttagagtcaaactataaaaaaattgactaacattttaagatgtattttctcatcatattaatatgcaaaaaattataatttatagtacttttcatgtagttttagaatatttatttttttgtttaaaatatcaaattaatgtgatctaatttacctttaaaaattagtcaaattaacttacaaataattctgaatggagaaagtactgacttaattgaaagatcatgaaaaaaatgaatattaacttgagacagctagctaattataaaaactcataaatatccaattttaaatctacttcttaggaattatagaaggttgatgtcttccgcatcaaggcacattcatatatactattccctctgtccaataatagtcgtccactatactattttagaatattcagactggtctatattatgaaatcaatggattattgtgcacttagcttttaatttattcttatcattaattatagttatttttctattacatttatcaggatattatatttaaaaagtgataataacaaaattatatttttatttataatttcttaaagaaacctctaaaatcgattggagtatggtaaatagtcctgagaacgttgaaaggatagaatgtggggagttgataaaaatgtgaaatcgtaaggtaattggaggatccaaatcacatgcaggataagtcaaaccaaaaatattttttgtcaacaacatttaaagtcatactaaccgcggcagagttgtcaaatattaattttcagtcttcaatttcaaaatctttgactgtaccaattaagtagctagggcatagtcatcctttactcatgatcacaaccgacctcttttgacttttgggtataacctactttatttgataaatctattaagaaaataataattgatataacgaataaatttattgatatttttatttattaataggatctcaaacatatttattcacagacatcctttactcatgatagtttttaaagatattaattcactgttaacaaaaattgagggtatatgataaaaaaaattatccttaatttgtcaaaaatgacaagtaaaaggtgaaattaaaatagaaaatatttggcaagggaatagaaacattggaagtacttttgttgtatatataattgttttcccttataatttgccacgtgattattttatcactatgttaagactaatcaacacacacaaaaaaaaaacttaattatcctaatggttcattttgcaaagatggtgtgttaaatagaaaagaaaaaataatacaagaatttaacgaagttcaaccaagtaagtacatgttttctttattcattgttgagaacttaagttgctattactgccccgaggactaaatttgaccgaacttcgttaaattcataattatttttttatttattatgattcgtgtgctagttaactaatgatcttttgatcaaatttctcatttcgcgtatcaaaaataattcatctgattttttttttttgtctaatatttgtaggacgatcagctggaatcagccaaagccgatatggaagaagtaatggaagaaaatcaaaggctaaagaaacacttagataaaatcatgaaggattatcggaatcttcaaatgcaattccatgaagttgcacaaagagatgctgaaaaaactaatactgatgttaaacatgacgaagctgaacttgtttcccttagcctaggaaggacttcaagtgacacaaaaaaggagttatccaaattaattttgagcaaaaaagagaatgatgagaaggaagaagataacctaaccctagcattagattgcaagtttcaatcatcgaccaaatcttcaccatcaaatctcagtccagagaatagtttaggagaagtgaaggacgacgaaaaaggaactgatcaaacatggccacctcacaaagttctcaagacgataaggaatgaagaagatgatgtgacacaacaaaaccctactaaaagagcaaaggtttccgtcagagttagatgtgacaccccaacggtgaggatatttaataatttacgtgacgttctttcctttttaactagtcttaaaaaacattgaaaataagtattatattgtgttagtaatgaacttattgttttattttctaaccattagatgaacgatggatgtcaatggagaaaatatggacaaaaaattgcaaaagggaacccatgtcctagagcttactaccgttgcacggtagcaccaaattgccccgtaagaaaacaggtaacataatcattttgttcgatatgatgaaagtcatttttttttttggaataaagttagttattcatgaataatagaatacgtcttaattttaagaaaattttattttttcaggtacaaagatgcattcaagacatgtctatattgatcacaacatacgaaggaacacataaccatccacttcctcattcagccacatcaatggctttcaccacttcagcagccgcttccatgctattatccggttcatccagctccggatcgggccccacaagtagtacagcctctgccacaacctctgcgctcaactattgcttctctgataactcaaaaccaaacccattttataaccttccacattcatccatttcttcatcatcacattctcagtaccctacaatcactcttgatttaacatcaaactcgtccacttcctcatttcctggccaaaattatagaacaatcgcgaatagtaataattatcccccgcgatataataataataattcatccacaaatattctcaatttcagttcctttgaatctaatcatcttcttcctatgtcttggagtaacagaaataaccaagacacccattcccagtcttatctacaaaacaatataaaaagcgcggcatctacacagactttattaccacaagacacaattgcagctgcaacaaaagcaataacatcagatccgaagtttcaatctgcattggctgttgctcttacatctatcattggctcacgcagcggaaatcatcatattgacgaaaaatctgggcagaatatgaaggttactgagccatttccagtgctttgtagcttcccatccacctctcctggtgatcacaaagattacacactgtgattcattttaatttctttagttagagtttttgcttgtacgttacaagtaaaaaactggtatcagcgttattaatcaggttgtatttttttaatgatttggagatatgtagtccaaaatgtagatattttagtatttagtgaattaattgacacttcgttttgctgacttatatttaatgagtttaactactatccaccgacggtggacaaaaaattacacgggcatattatttttggaaatatttaatttttttaattaatatattttaatattattaatattaaaataaaaataataacagagtgttatatggtaacttgaattataaattaattgtacaaatttaattaggattcttatttgtcttaccaaaaataaaaaatacataatttcttgtgttttcttattggaaagcacttcaatccttcaaagaaaatcattgccaacatattatttttttttataagaaccggtacttgttgccattgaagcaatgctagcaaaatattaatatgaaactattccagaaacataaagtgcaacaaaatcaacatattcaaacttataagagtaagcaaacaaaatcaaacactattaaatacggcccatgatttaatcacaattgcatgcttggttacatttttttaaacgaaatccttcttttgaacaaacaaactctggaccaataatggatttatcttttcttgatctactaattcgatttttgcgcacactaaaaccattacgatgagcataatcaagataaaatttaaatccagtatcaagtgattgaaattccataccgatgtaaggctctcttaattcttgctcacctagttgaggaacaaaagatacaactgcattcatgttgctttctatatcctccaaggaatcttcaattccttctacattttgctcttctaaattagagatttcaaaagtttcttgcaatacacaattattagatattagattgatagggtaagttagctttaaaatt

SEQ ID NO: 419 - DNA, 4127 bp, Solanum lycopersicum; identical to SEQ ID NO: 304

SEQ ID NO: 420 - DNA, 5565 bp, Solanum lycopersicum
taacacctaccttgagaattgagtttacatcaaaaacttggcaaccatcaatcccaagattatcttctttcaccaacaaacaaaaaccaaacatatcctcgcgtactcgctctgtctctaattatttatctatttttatttagttatttatttaaatatattaaaagaaaattattttatttattatattttaattaattactttaaaaaatatgtaattttttaaaaatattaaatttttaattcatctattttataataaatagatataaaatagtaaatttactatgttaataattattttcttaatataaatgttataattgaaaagtgaacgagtaattagtgacggagaaaatatatcaaaaaatattttttaactataagttaattaataacaataatttaattaccactaaacatacattttttgtgacaatcaacaccttcagtaaatctatagcgacgctaaatttttttattttattaatgtacatatttattatcactaaaatctatttttgttaccgtaagtaacaaatcatattaaccattgctaacttatttgagatggaaccagagatgctgtttgtttttgggccacagagccatgccccaaaaactccatcatttagagttagacaagtgaaaaagtaaaagagcacaaaataagcaatagatatggaaaacaagaaagagaaagattcattagtagtaatatatagataggtagtaggtgtaaatagtaaaaaactgagtaattttctttacttgattattaatactagtaataaatattcttttcaattcactcttttgaatgtgttgttgttggtgtcacagtgatttggacgtgaaagcgcccatcttttcatgtccattttgacattgatagttgatatgtcacttgccttgttcatgtcctctttgacccttaattactactactactagtactactaccccctcacccccccccccaccccttttcccttttttttcttttaaaatcttttttctttcatcttcaactttattagtagtaattaaagaagacagagcaaataaaaatgggatctttaggtggtgaagtatcagtatcattattacagaagaagaaaccaatgtggtcatatccaaaggttatgggtgttcatccttctgagagatggggtcattcttcttgtaactctaatggatttgtctatgtttttggggtaagtctatatttgcttcttcagaaatattagttggaactgtatgttcaagaaatgggagttttagttttgtcatttgcttcatgttactgtgtagttatatttttggttattagaaactactctttctggagttgtacttttgttttcctatatatatgttagtagtatgtatctatttgtttcttcttgtttttgtaatgtttatatataaaaaaaaaagaaaagcaactacatatgtgtgaaatgctcagtgatgcattaaaaggagaaaaaaaatgaagtgaaggagaaattcatattttgctttaggttatgtctgttttgctttttttatatttagagaaactgaatttgttgatgtttttcatgaccaaacatgtactcatgaagttattttaaagatgtaactcaaattttcaacaaatcaagtaaaaaatttcattgtttgatggagatcatgctgtttgttttttccccactgttcttgaataagtgttaaggtgaaacttaatctgttaatattcatcaaaaagactgctttcatattattagtctgagagctcttggtgcagcgttgatatgtttagacaaatttatgtctgatatattcttaattaaattgtatttctctgtttcagggatgtcgcgggggcttacattttagtgatgtacttgtactaaatcttgaggcaatggcttggagcattcttgtgacaacaggacaaggaccggggccaagagatagccacagtgctgttcttattggtcacaggatggtggtgtttggaggtacaaatggctcaaggaaggtcaatgatattcatgtattggatgtcaggagccaagaatggactcaactcgaatgtcaaggcaatccaccttcaccgcgtgaaagtcacaccgctactattgttggtggtgataaattagtgatctttggtggtagtggtgaaggtgaggcaaactatttgaatgatttacatgttttggacctcaaaactatgaggtggtcttctcctgaagtgaggggtgaaatgcctgttcctagggatagccacagtgctgttgcgattggtaataggctttttatatatggcggagattgtggtgaccgatatcaaggcgatgtcgatgttcttgatatggatacactaatgtggtcaaaggtacttgcttcagtattcttcttgattcacagtctggatgtagagttctaaagattatgttagatgataattagttctctttcttaccagctggatgttcttggaccgtcacctgatgctcgagccggtcatgcctctgtgaattttgggtcaaaggcaagtaactgatgctgtagcctttgtgtaattaggctctttgtttttagtatgtactgcaaatggagtaaagctttattttcggtgagctatcctctagagaatgatgttgaaattcgatgttctacaggtatacgtgattggtggagttggagacaagaaatactacaatgatgtttgggttcttgatgtgataaattcttcatggactcagcttgatgtgacgggccaaaaaccacaggggcgattttctcatactgctgcttcccggaacacggatattgtaatctacggagggtaagtctttaatccattttttcctgcctgatctcagtagattgtatagctttaaatttgtttcttcaactttgcaggtgcggcgaggatgagcgaccactcaatgagctacttatcttgcagtttggagtagaatatcctaatgggactagcagcttgtctggtggcagggtttctgggaatacaagtcattatgataagaaaagatttctgaaagaaagagacaatagctcggtatactagagcgagaacttgattcctttctcatgaatttaaacaattcaagatcatttttctgattcgtataaattgatttggcaggaagctatatgtaggggaaagaaggaagatatacaaacgacgggatctcaagaacttgagttcgtatcaaaagcagcttttcgatttagttctggtaggttataaaatgattttgtcatgctagcagccagtagtttcaagacatgaactaagcatgactaacttataactctcatgtattttggaagacacattgcatccaaagaggcgaagaatgagtcacaattcacacatatttaatctggagtcagatcaagaagaagatcagtctccttctctgtctcaatgttgttctcctccgtcccaatccgatgtagaaatgagtactattaagcaagtctctggttctggaactgcatcagatcggtttcctttcgcaaggcagcaacatttgatccctaacaactgccaaccaaacccgaggaatgtcatagcaaggaatcctcatgatctgcaactatttcgagaacaatcaaatccgtcaaactcatcaggacatgtaccccccgccgttcttatggataagcaggaagtgcaatgccaatccttagagcctggacgattccacaacttggtacgcctttgaagttagcaaaaatttgtttgagtcattgtagcattttccaacttttatgttgaataagaacctaatgtctcaataatataatgtactactcagattggagctgagatccgaggaaaagtcgatggagcatttgactctggttatctaatgactgcgattgttaatggaaagatctttcgaggtgttctgtttgctccggtaaggtcatataccattcaattgaaccaaattgtcaattagtacctcaaactcatcatccatttgattcttgttataaaaaaaaaaggcacctgatctagtaccacgaggacccgtgcttggtcataatccttcaccctctccgggacatattggtgtcaactacgcgaatcatataagtctgggatgtcgaaggcaacctcagcagcagcagttggtgcaactgcaagttccagaactcggacgacatagcataggtaaagtaccaattagaagatcaacatcatcggtgatgagatcatctcatcaactagacaaggatacacagaaaagaagtgaacttgaaggagtggtgctcacactaggaggtccaggatgtggcaatgcaaaaacttaaattaatgataataacagagaattagaaagtctcatgagtgtgtgtttttgtacatgctaattaaggtagatatattattggatccattctctatgtattcctttcaatctaatcttgttagtattagttcagtcttgtagtaaacctcctttcatctaaagcagacatgtatcctctttctgtaatttcaagctaagttttgcaaggtgaatatttctttcttattttttaccaacaacatgcaatactttcaatttttaactaatgttggatgtaagatatgaacaactgtaataataatagtatatattttgaggtgatatttgaaaaagagtccataagtaaggtcaggttttaaaaaagaaactagggacggaggtgatattggggcggggttaaacttatccgcatcgagtgtttacaccaagtcaatacatgcatgccatgtgttgaaacttgttgttcattttacttcattaaatcacataataatggaaattgcattggcttggtgtaaacattcgatgcgggtaagttgtttccggtgatattttataagggaaattacgtgtataagtaaatatatacaagttaatttagttatcatagctatagtttgtcttaattacagttcgcggtctacttttagctataattatgcggctcaacattttagttttcttataattcgcacgttttatattttgaaatttatataataatataatttgtataagtagttacatttcagatgtttataattgtataaaatcattattttgagattatataaaaaaaactcaatcatacaaatctatccacaaattaaacaaattcacccacgaattatataaacgggacagtctaaatcatagctacaattcttaaatatgcaaactataattatataccataattaaattaattataataactatttgcgagaatttcgtataaatatatatacaagtacaaccttgccccagatgcaaatattaacaattaaaagccatacgactcgaactcatcacttaggtcatatggagatgaccgatgagtgtctactcaaatatcaaagccgagtgaaaggaaaataaatagtaattcaacgtaaaactgtgaagaagtcaaaagacctctcaaatcttaatcgtactactcgcatgtgacatgtaaaaacatgaaaaataatttttataatttatcttaaaatataaatttttt

SEQ ID NO: 421 - DNA, 8421 bp, Solanum lycopersicum; identical to SEQ ID NO: 333
  modified_base (128)..(740): a, c, t, g, unknown or other

SEQ ID NO: 422 - DNA, 8822 bp, Solanum lycopersicum
cccctcctttcaattactacttctaccaaataatcacaaacattttttatttcttaaaatggtcaatctaataatcaacccatgtggatgtggccaactccaaaaacatgaattctcaatcacataaaacaaccctacatttattgacaacatactcccatttcactatatccacatatatgttttcatatcttaatattaagaccaattattaataagttctatttattttatttttacaacacaaaagtaaaggttcactcacaatcaaagcataggctcaaacaaaaaatagaccccccacctcttttgttttttccccttcatttctgatcaaacaaacacactacatttcttttttgcttctctaacatattccctcaaatttcttggaaatctttcaagaaacttttaccaggcatctccccatatattccaaatgtttttttattttatatgaactttatgaaattgaacttgtgttttgtttatttttttgtaaaagttataatcgttaataacatcaaccttaacttaactttagcgtataattatgccctccaatttcgagtgtgcataaatagacataatagacctagaacctcatgcaagataaaacagttaatattatatagtttattatacacactcaaagttaaaaaaaggtcacaatcactctcttgaggatcatgagtatgtattagtcttaggcaaattaaaaatacagctactcaatcaaccaattaagttatgattatttttggacttaaatttgagggtaaaaaagtattggagaccaaaaaaaaaaatactgttggataaacaggtccaccatattgcttcaattactagtagtataaaattatgacaaccccatttgtgtattcaaccaaaaattcaatcttttttgagtttcccaaaagtaatctgttttagggttttgaaattgacaagtttttctatgtaatagcaagaaaaattttgtttggaagagagaaaaatggcttctggaagtagaacaaagcattcttatcataattcatcacaaggtcaagctcaatcttcaggtacaagtaatatgaattacaaagattcaataagcaaagctatagcacaatacacagctgatgctaggcttcatgctgtgtttgaacaatctggtgagtctggaaagtcttttgattattcacagtctgttaaaactactacacaatctgtgcctgaaaggcaaattactgcttatttgactaaaattcaaagaggaggtcatattcagccttttggttgtatgatagctgtagatgaggctagttttcgtattatagcttatagtgaaaatgcctgtgaaatgcttagtttaactccacaatctgttccaagcctagacaagtctgagatcctcactgttggaactgatgttaggaccctttttaccccttctagctctgttttgctagaaagagcattcggggcacgtgagatcactttactcaacccaatttggattcattccaagaattctggaaagcccttttatgcaattttgcacagggttgatgtaggtattgtcattgatttggagcctgctagaactgaggaccctgctttatctattgctggagccgtgcagtcacagaaacttgcagtgagggctatttctcatttgcaatcacttcctggtggggacattaagcttttgtgtgatactgttgttgagagtgtcagggagttaaccgggtatgacagggttatggtatataaatttcatgaggatgaacatggagaggtagtggctgagagtaaaagatcagatttagagccctatatcggtttgcattatcctgctacagatattcctcaagcttcacggtttttgtttaagcagaacagggtgagaatgattgtggactgccatgctacccctgtgcgggttactcaggatgaatcactgatgcagcctttatgtctagttggttccacacttagagcacctcatggttgccatgcacagtacatggcaaatatggggtctatcgcctcattaacactggcagttattatcaatggaaatgatgaggaagctgttgggggtggccgaaattcaatgaggctgtggggcttggttgttggacaccacacttctgttcggtccattccttttcctcttaggtatgcatgtgaattccttatgcaggcctttggactccaattgaacatggagttgcaattggcatcacagttgtctgagaaacatgttttaaggactcaaacactgttatgtgacatgctccttcgagactcaccaccggggattgttacccaaagccccagtattatggaccttgtgaagtgcgatggtgctgctctatactaccagcggaagtactacccattaggcgtcacaccaactgaagctcagataaaggacattgtggagtggttattggcttaccatggagactcaacaggtttaagtactgacagtttggctgatgctgggtatcctggagcagcttcacttggtgatgcagtttgtggtatggctgtcgcttatataacttctaaagattttttgttttggtttcgctcccacacagcgaaagaaataaagtggggtggtgcaaagcatcatcctgaagacaaggatgatggacagagaatgcatccacgttcttccttcaaggcatttctggaagttgttaaaagccggagctcaccatgggaaaatgccgaaatggatgcaatccactctttgcagctaattctgcgagattcatttaaggatgctgaggcaagtaattctaaggctattgtgcatgcacttggggaaatggagttgcaagggatagatgaactgagttctgttgccagagaaatggttagattgattgaaactgcaacagctcccatatttggtgttgatgtcaatggccgcataaatgggtggaatgaaaaggtcgtggaattgacaggtttatcagctgaagaagcaaaggggaagtccttggttcatgatcttctgtataaagaatcacaggagagtgctgagaaacttctgtacaatgctctaagaggttatacctgtctatttattttattcatttccaaatgatagcacagtttttaagttgtagagtttctctgctctgcatgagtggtataatcttatcttttcccttctttgtgtttgacagctgacgtgaagtaatcatgggcttctagtgattttcttaactctgaattctcgaaacttgaaaaaactgtttgttcacttcttcttgttgaatttgtcaactgaagcatgcagtcttgctttgtgtgtgttgggggtagagggatagggcatggtgtgcaactaaatggagaggtattatgcacaaaaccaagtcaatcaatcaacacacctcaattctaaactagttgggtcgtctatgtgaatccttcatatccattccactccaattgtaccatttgatggacgtttattttgatccttgcttttatttggtagaagttgtgtagaacaagttcgttttaaaaagaatgtgcccttaggcataatctggcatttggatgcgttcaaattgcaaacttttactgcaaacgattgtatatagtagtggttatgaggatttacttgctgatagcattcaggatcacttgttcgccttcggttatctgatgagagtatcactaagctgttagcttctttcttgcttaacaaaaaccatctcttgtacagtacagatttaggcttattcctgattgtagggaacctgctctctctattgtgtgcgtatgttgactcttacatagtttgtaactgaaataattggcatcaactccgctccttttctactcaactcctgcaacagacaaccaaagagaaaaataaactaatattgtagtcatactactgcaggcgtggaaggtaaaaatgtagaaataaagttgaggacatttggagctgaacaagtggagaaagctgtttttttggtggttaatgcttgctccagcagagattacacaaacagcattgttggtgtttcctttgttgggcaggatgttactggggaaaaaattgttatggacaagtttattcacattcaaggtgattacaaggccattgtgcacagccccaatcctctgatccctcccatatttgcatcagatgagaacacttcttgctctgagtggaacactgccatggaaaagctttctggttggtctagagaggagattgttggaaaaatgttagttggtgaaatttttggaagttgttgtcggctcaagggcccagatgccatgacaaagttcatgatcgtgttgcataatgcaatcggaggccaggacacagacaagtttccattttccttttttgaccgaaatgggaaatatgtgcaagctcttttgacagcaaacaagagagtcaatatggagggtgatactattggggctttctgttttatacagatagccagtcccgaattgcagcaagctctaagagttcaaaggcaacaggaaaagaagtgttattctcagatgaaagagctggcatacatttgtcaggaagtaaaaagtcctcttaatggtatacgctttacaaattcattgttggaggccacaaatttgacagaatatcagaagcagtatctagagacaagtgctgcttgtgagaggcagatgtctaagatcataagggatgttgatctggaaaacattgaggatgggtaagtctttcttattcgattatgcttgctaagaagttctttcaaaactaatgttgctcaaatcctccaaaaaattgcgctgggtgcatgttagatcctccaaaattatgtatttttggaggaactgacatggtgcggcaacatttttggaagtccaataaagtttaaactaatactttctctatttcatgggcggaggttaagaaagaaagatttttgaacttgagtacatgtgaccttatacataacgtactatttatgtggctctaaatgcatgtcattaaggatagagtgggaactttaaagttaaaactgtttccaaaatataaaaagttccattcttttggaaaattgactaaaaagaaaagagtctcacatgaagtggaatacagggaatagctatttattcatgatataatatcttctggtgtaactcaggtgtcaacaacatacccagtataaccctacaagtgggtatggaagcgtagtgtatgcaggcctttcccctaccttaaaaaggtagagagttcggtttcaacaaacctcgacttaaaacagatagtcaaaaataataaacatgatattttcttttaaagaacaatggcctgcaattggtattgtagcaatgttgtcaaaggcgggcataatccctgaagcgagactcaaaatgttttgagcgcttcgcctagcttaatgtgtgctttagtgttgtcatcaaggttctgaagtatactttttcttgccaatgagcctcttaagactaaagaattaatatttcactttgtgtaaaaaattcaatttcattgttcatatttgtcattcgttcttataattattagtctcggacaaaatatatacatatatctttattttattttttttgcatatttctttcattaaaggccacacttaatttgtgcttgtggttattaccccaacggaccttagagttatttgcgctttttgcttttggcaacactgcattgtagtatttgaaatttaactatttgggattatttccttcttttttgttgtgttcttctgtaggttgcgggaggggattatgggtctgtatttcaattctatgtagtattagcaaccttcttcctttcagaatttgactgacctttgatcttctaacagttcactgacccttgagaaagaagatttttttcttgggagtgtaatagatgctgttgtaagccaagtgatgttattgctgagggaaaaaggtgtgcagttaatccgtgatataccagaggaaattaagacattaacagtacatggtgatcaagtgagaattcaacaggtcttggcagatttcttgttgaacatggtgcggtatgcaccatcacctgatgggtgggtagagatccaacttcgaccaagtatgatgccaatatctgatggagcaactgttgtgcatattgaactcaggtacattcattaatcttctcttcgtgtaactacaggaagatgtactatattattgataactctcacccctctcatgcaaccttgattttttaaatggttctcgaatgagtcttcagttctcacttgaatgccatctgctgcttacttgtgtcatttatttcagggttattttctaagtggataatatttctgattgctttaacaggcatgtcagaatatgagatttatgatccaatgaatattaatgtaacgttaaggagtataaaaaaatttcatgtatgtttagaccttgtggaaatttagagtaggggctataagcctatcaaatatgagcacactcaagtaaaaggtgcatttcagacttgtaccacatctctttcgcatagcttttaccctgccttctctttttatacctcattttctatccatatttatcatttttttccttcttctatggccttcctttgactaatcagtggcatcttcaacctataaagtgaaagtttatacacttaggtaaatgatcagggcatcatcctcttctttttattggtctcttttaactcgactttaccattgctcatctttcttctttccacttcaattttcccgtgtttggagtaggaaaagcatcttctccacttcaaactcacatttcatctattaagtttctcttccagttttgaactgaaacagcagaagtataagcttctaatgaactgcgtaaatacaactcctttatatacaacaactttggtggacttcataaccaagttattataatctcaagtcagcgataggaattagttgaagcatagccttaatgttttagttttgaaatctaatcttatacaccttatcatggtgcttgagtgtggtacttaataactgccaagcaaatacttgtgcaggttttggtgtttactagcatcctagatttcactatattagctttcctggaggttgagttattccaaaatattcatcttgccagtgttttactagcatcctagattgcactatgttttccgaatcaactctttccgtgtagtaaaaattgagttctaggggttaagtttcagctatactactttttctattaaaaataatctaatttttcttttgacataggattatatgccctggcgaagggcttcctcctgaattggttcaagacatgttccacagcagtcggtgggtaactcaggaaggcctaggactgagcatgtgtagaaaaatgttaaagcttatgaatggagaaatccaatatatcagagaatcagaaagatgctatttcatgattatccttgacctgccaatgacccgcaaaggtccaaagagtgttggctaggagcttacagcacacagtaagagaagaacctgtaatatctcttaaaattgcatgctggtgagattctggtgatgcctctgatcctttaatggaacttgacacaggagagagcaagtatgggggattgatcggcatctttctaacagtattaaaccagctgtttccagcattttccgacttgaatttgctgggttttttataactctgaactagtagtctctcagcatgtcaagttgagaaagctattgctccttagtgcatggtttttaccaaagattaattcgacatagtaagtggctaatggccaaataattggaaaatggttagcatgattccaaattaattgatcccagagctgttgtgtgtagcataacaagtgtattgttgtataaaaggtggaataaatgtcatcctttctatgtctggatgaatggtgtctcccactctttgtaacattaggatttgtgtaacatgaacatactgagaatcttatatgacttggtggttcattttcttccgatttctggaattaattttatggaatttggactcttcttgcttaatgaattcttcattctgaacatcattgcgtgtataatagctttaaattttgaatttgcctctagctacttttatacttagcttgcatgcaattgaacaattcttagttggctgaaccatcgatgaccctctaaatttgacaaaaaaatttcacttagacacctcaattgaactttgttcattttagacacctcatgccatgttccattgtgtcattttgacactttttgttgacattgatacactcaataccaacactttgaaagactcatttaatcattctttattcattcccaaaaacttgaactccttccatggagaaatagatttgattgatgctacaaacaattaaattgaatttcaacataaagagatttcacaaaaaaaacaaaacgaatttcaacccattagaaggcccacaattgatgttgtcataaagattttagacctacttatatattttaagaattctttaatgttaacagaatgtaaaaaaaaaataaaaaaattaacgtaattcgaatcaatatcatcctatttacactaaaaaaatgtctttatattattaacaaagaaagaccaaaatttgtcctccaccaatttttaaaaaaatgtctttatattattaacaaagaaagaccaaaatttgtcctccactaattattaacatgggatttaccacatggattaaaccccacacaaaaacaactctttcatattctttgagattcatgtagcatgtt

SEQ ID NO: 423 - DNA, 4878 bp, Solanum lycopersicum; identical to SEQ ID NO: 350

SEQ ID NO: 424 - DNA, 6096 bp, Solanum lycopersicum; identical to SEQ ID NO: 353

SEQ ID NO: 425 - DNA, 4991 bp, Solanum lycopersicum; identical to SEQ ID NO: 356

SEQ ID NO: 426 - DNA, 2629 bp, Solanum lycopersicum; identical to SEQ ID NO: 361

SEQ ID NO: 427 - DNA, 4267 bp, Solanum lycopersicum; identical to SEQ ID NO: 362

SEQ ID NO: 428 - DNA, 3126 bp, Solanum lycopersicum; identical to SEQ ID NO: 363

SEQ ID NO: 429 - DNA, 3974 bp, Solanum lycopersicum; identical to SEQ ID NO: 364

SEQ ID NO: 430 - DNA, 3012 bp, Solanum lycopersicum
gcgtaagtgtaaataattagtctcttttttaacttagaaaatagtttaatccttagtataaatagtcaaaatcactggaatgaaaaacagtttttaatttttccaaatttgattctgataccatgttaaattcgtggttcaaaatcactgcaatgaaaagagcaatattgtttaactttttttaggaaaatcgaattgatttatagtcagttgatatagagtgaatacataaggaacatatacagttgatacaattgtataattcgttcatacacttaatacaaagtgaacccacaaggaacatatacacttaatataattgtattccttgatacaaaccaattttgttcgtgtctctactctctatttcaatttcgcttgactctttactttttctaatatgtagctataaatcgtaattaaacaatactatatctctaaatctcttattaagctcaaactatggtcatattcgaaaaaatccttttaaatattggtcccctctcacgattaatgatagttataactaacattcaaattttagttgtacttgacatctaaaacttaaaaaatagtacaagttaactttttcttttttttaaaaaaaggaaatacttgtatttatttttttaatatatagttatatttttggttatttgaaaatacttgatctgtcatgtatgctcagttaaatatcgtcacattatagagaaaaaagtaataggagaaaaaaattaaaaattatttcgaaaaatcaaaatttttttttgattgaaatgaaagatgggtttcccaatcgaggctggcaggataggtacattgggaaatttggatttgtgtgttgaaaatgattgttcaatttggcttttataacatttgtcgtttataatttgtagaaggctctctacaagttggtagttacaatttaatacaccttttaggcacgtgtataagtatatatagacaataaaaaagtagtataatatattatcaaattattatgaacagtacatctatgtcttcattgggagtgagaaaaggttcatggactgatgaagaagattttcttctaagaaaatgtattgataagtatggtgaaggaaaatggcatcttgttcccataagagctggtaactattaaattaactatcacgttatttttatttgtctttctgtctcattttatttgacgttattacgaatatcatctgaaaatgtacgtgcaggtctgaatagatgtcggaaaagttgtagattgaggtggctgaattatctaaggccacatatcaagagaggtgactttgaacaagatgaagtggatctcattttgaggcttcataagctcttaggcaacaggcatgcaagtttatgttttgacaaaatttgattagtatatattatatatacgtgtgactatttcatctaaatgttacgttattttacgtagatggtcacttattgctggtagacttcccggaaggacagctaacgatgtgaaaaactattggaacactaatcttctaaggaagttaaatactactaaaattgttcctcgcgaaaagattaacaataagtgtggagaaattagtactaagattgaaattataaaacctcaacgacgcaagtatttctcaagcacaatgaagaatgttacaaacaataatgtaattttggacgaggaggaacattgcaaggaaataataagtgagaaacaaactccagatgcatcgatggacaacgtagatccatggtggataaatttactggaaaattgcaatgacgatattgaagaagatgaagaggttgtaattaattatgaaaaaacactaacaagtttgttacatgaagaaatatcaccaccattaaatattggtgaaggtaactccatgcaacaaggacaaataagtcatgaaaattggggtgaattttctcttaatttaccacccatgcaacaaggagtacaaaatgatgatttttctgctgaaattgacttatggaatctacttgattaaaagatatgttattgtaaacttgtattagggatacatttgttctttataatttgtgtcccaactacaagttgttagggaagtaattaatgttgttagaatgggttaccatccacatacattcattagggaatggaccggtggtaacttatttttacggacttggataaatttatcttcacgaactaatttctggagttgagttagattcaagttccaatcaataagtgcatatgcactatgatattgttcatgtgatttttaggttacttatgttattatatatttgcaacgtctttgtgttacttcctttagtctatattaagtgaaacgtaagaaatttttttttcttactcattatttagtgaaattcttcgctatattatattttcaaagaaaatatttcaaaagagaaacagcaaaaaataacattactttgttttcctaagtatatatcataccctaaaaattcatttttaatatggatatagaaggaatatatggttttgtgttttatggtgtccaaagaaagaaaagtctactcccttacgaccttttccaccaatgatgaaacgattacatcaagggtctgtttggaaaggtcagataattgtaattggtgtaaacgtaataattattatcttaccaatttagtaattatgaatttacgatgacacacatgtttgtcaccagtctaattataagtgccttgtttggttgcacatatatcatcataatgttatattgaaatttaaaaataaaattaattattttaaattaaaaacttgcttttgtaataatattaaattgtcctatttttaagtaaggtttataaaatataatatccgatgcttatattttacaaattgctcatttgttcacggtaaaacaaacctatgtgtctaatggttaatatgccgaatattctacatgtgtttaaataaaaattttgaaataaataaatgtgacgtgacatagcttcgactaacgtgtatttattttt

SEQ ID NO: 431 - DNA, 4335 bp, Solanum lycopersicum
tccaatttcaccagaacggtaggtggcggtgagatttattggtaagacgaagacgatggagaaaagaaggcggtccctagtgggtcgcgtggtggtctttcggtgtagggttactaattttatggagatcggagaaagatggaaagaaaatagtgaggtttgaaatggaaatggagacctacaggtcttgccggcaagaagaacggtggcggcgatgatgactttcgccgatggattttggtgttacatgggggggggttgtggagtcccaaaattatataaatttaaaatctattattttatattttatctaataaagctttgtttaataacttttaaaaataaataataaagataattatgatatgtaattaatttaactgacgtaaatttgacatgtcgtctattcaaggctagtgaactaaacacatgataagaggggtttgaaaatattcatttgatttagtttaacaatttacttgataaatgattaagtacaaaaattctacaaacttatacaagtataagggtccggaagacattcaacctatataaaaaaagaatcctttggattttaaaattctactttgtttaccccgctgtaattagaagcaagaaccaatcagcattctctgtattgccaactcagatattaacacacgttttaagtaaatggaaaattaatttatttgacctagtattgttttaaatgatatttgtaattctaaaatttcaatttatcacatgttttagaggataaaatggaagagcaattttgtatttcaattttcttaaattttgtgtcaagttaaaataagtcaaaaaacacaaaaaaaaaaagaaaagagaagagtaatataaagtgaattggacggcaacagatttcttagtttgatatagaaaacaaaaagaggggtatggttacttgttagaagatttacagggaataggtgtttatgtgtgtgtatatatatatccatctattacaagtggcttttctaacaccgatcgatcttttaacaaactccctaaacacactcactcccctcccctccccttcttttcttctttgtttgcttggctctctctctctctctgacttgagtccactcattcttcaattcagtctttggattttctcgatctacaggtgaatttctctctttttttttctcgatttcgagttttatatgataatttgacaatgtgcttgcaatttccctcatctttttgtttggttgatagtttttcctattaattgtgtggaagttttactaatcccttggatctgatgcgtgaagtgctgatataggatctctcattgatctctagaacaataggatatggatttcttttggcgtgtagaaaactttggtcagatggattgagtgcagaatgttccatcttttttctctaattcttaattgtgatctgtttataagcaggaatattggtatctcaagatgaaggcacttatccttgttggagggttcggtactcggctcaggccactcaccctcagcgtcccaaagccacttgtcgaatttgctaacaaaccaatgattttgcatcaggtacctactttatttatcacaataaccagccttgttcaacttacatattcatcatgctttggattgtggttattcccaactcgttattttggttttgcactggttatcagatgagagaatttggtgttgtagatatcatcaatagtttcaaattgcagttttaaacatctcattcctcatatgtgtgttaggttctgaattatctgtattgagactcctccaaactctgccctatcatcatccaaatatagaaggatgaatttaaaaagcagcaaagcgtattgacttgtactattcttttctaaagtaaaagttttgtcttcagatcgaggctctcaaggctgttggagtaaccgaagttgtactggctattaactaccaacctgaggtcagtttcttacccattacagaatttgcaactattggagattttagtacagcgacttacttgtaaggtaacacaacacaagcgtcttttggtacaggtgatgctgaacttcttgaaagaatttgaggcaagccttggaatcaagatcacctgttctcaagaaactgaaccacttggcactgctggtcctcttgctttggctagagataagctgatagatgactctggtgaaccattttttgttcttaacagtgatgttatcagtgaatatccatttaaggagatgattcaattccacaaatcccatggtggtgaggcttctttgatggtgaccaaggtaaagttgtagttatttattattctgatggaattgaacttctttttggatatttcaacaactccgaggcaattctgaatacggaaggtaaatattcactggttaatgtaggtggatgagccttctaaatatggtgttgtcgtcatggaagaatccacagggcaagtagagagatttgtggagaagccaaagttatttgttggcaacaagatcaacgctggattttacctactgaacccttctgtcctagacagaattcaattacggccaacatctattgagaaagaggtttttccgaaaattgcagcagagaagaaactgtatgcaatggtgctacctggattttggatggacgttggccaaccaagagattacattactggcctcagactctatctggattctttaaagaaacactcttcacctaaattggcttcaggaccacacattgtcggaaatgtcatagtggatgaatctgctaagatcggagagggttgtttgataggaccagatgttgcaattggttctggttgtgtgattgagtctggagttagactctcccgttgcactgtgatgcgaggagtccgcatcaagaaacatgcatgcatctcaggtagcatcattggttggcactctactgttggacaatgggctcgtgttgagaacatgaccattctcggagaagatgttcatgtttgtgatgaaatttacagcaatggtggtgtagttttgccccacaaggagatcaaatccagcatattgaaacctgaaatcgtgatgtgagatatatttgttagcactaggaaaaatataagtttatgtattcagtttcttcatgatgtcacgtattcctgttttggttggtttccagttctcctcttcttcaagtgttaaaacgtcagtcctgagaatttgagtgatgtaaacttttcttggtgaaatttttgttatgttgtgaaaggtatgagatattgtaagactgggaaatgtgtaatttttgttatgtatagataaataaaaatccctcttatttgtttatactatttttcagttcttttattcttcaatatctctaggtctcaaaggcaaattgcaaagtcatacaataacaactacttaatttgaagcaaattagagagtctttattatcctcacaatgattagcagataattgtggtataaaagtgtattatgtccatgatgtaactagtcaggtttgtatctaatttagcatgtgtcggtgatcttgtgatgttgctgaattacgacaagataaggtgtaggtaagataaaaataaaagagaagagggccctattgacagctctattttgctgctccaccaactggcaaaaaaaaaagaagatagcatcagatttattccaaatagcacgatcccttaaaattatttatatatttcacttagattaaactatttgaactttattttttgtttcttattcacctcaataggcgcacgagaggtatttgatttggtgttttcatggaaaaaatatttctttatcctttcttcctatttaattttccatcacttcctccaccacaccagttcattgtcgccaccatacatcgttcttcttactctggatactttagttcttctgcctacatcgttaattcttctttttgttccatttccattcatattaagattggcagcaatgacattgccgccatcattactgtctttttcatcatgttaatttgtagaggacttgaagtttggaattgagagaagtattagaaatatctttaatttggtgtgaatgattagttttttcttctaactatttgcaggtttaaaaacaccgctctacttaagtaaatgaacttaaatataccattgatcttccacatgagtgaaatataccctaaattctcaccaagtttaggggtgtttaaaacacttttgtcaactttttattaagaggcttagcttatgctccaacaagagtttgagactaattgttatgtcatgtagcagatcgagggtgtatttaagtgagttagccaagta

SEQ ID NO: 432 - DNA, 6205 bp, Solanum lycopersicum
tgaaaaggtaaaactatataatttagagaatatatatatatgtatggttagtggatgttgaaaaatgagtacatgtaatactttgaaaaaatattgataaattttggaaacatctaaaatattataaattgaagagggagtaataaatcaatttctactactattcttatatgataaaaggaaaaagaaattttgaactagaaatctcaatccacttgttttaaaaattactttccaattgcattttatcatacgtgtattagtcacacataaaatattgtatgcacacaagtacatgtattcaactaatctttacaaatcaaaatactgccacgtcttaatatatatatatcaaaattctgtatttttttttagaaaaaatgcatcggtattaaccaaatttgctcgggggaaaaggaaacctatattagttatccctttcttttctcacctttttaataattataaataaaaaagataatttaactaatctactttaaaatatatttattcaaaaaaaaacaaattgcagtcacattaaaaataaataagaagaaaaacaattttattcatcaaaattgctagtataattttattctatcacttattcaactaatgattattagtggagcatgaatttaataccctttatatagacataaccttctaaaattataattaaaactgaacacatattttaaatcccaaattcaaattaaacacgacttgtatcaaaatttcaatatttataattgtattataaaatcttataaacttgtttatatatatattttttaataacaaataatatagaccacaagtaaggaggtaacagaagaaaacaagaaaacggaaaaagagtagctataacaggaaattaccattagatgggccccacaccagcagctcaatagccgattcgtttgaaagcgaaaagttcggccctaccaatctccacgcggcttaataagggttaacaatcaccatacctacgacgtcgtatgagtacaacagtcaacataaacaattcttttattttttcacgttcatcactgtcacagtatccctttctctccgggaactcttcgtcagttttttcgactttccccatattatcggaatggtgagaaaattgaattccttcaggaagagttttgaagacaaacgattaagagaacgtcttctttctttatgcaacggcgtcgagtacactgagttacctggtttccggcatagtcttgatcaccaagaccaagaaacttctggatgttgttcttctttccgggagaggttttctgagctatggaaggattggaaaagagtttctgtaaaggcgatggagatgggtcgaaccgacccgagaaagatcatcttctccgccaagatgggtttggcattgattcttatatctttgttaatcttttttaaggaacccgcggttaaagagcttggtaaatactctgtatgggctattcttactgtcgtcgtcgtttttgagttcagtattggtaagtattgcactttttttccccttcatctctgtttaaatgtatgcttgaaagatttaaactttaatgctaaataccatcgaagatttgtttttatacttgttgtaacagagagtcaatattttaatttaaatttcccagatagaagtaggccctaacatttatttggtttttcatttttgggagggattaaagattcgcatttatttgtattctgtatagctttgtatgggaaccttttttaatacatatacactgtccacaggagccactctaagcaaagggtttaatcgtgggcttgggacattatcagctggaggactagctcttgcaatggctgaattgtctcaattggctggagaatgggaagaagttgttatagtaattggtatatttataacaggtctggtttttcgttcagtacttacgacttatgtgaattgatgttcatctctttgttatattggtacattgctgacttaagtttgtttggtgtttctaggttttttaattacatatgcaaaacagtacccagcaatgaagccttatgaatatggtttccgggttttcttgataacgtattgtttcatcatggtatctggctatcacacaagagaatttattgaaacagctgttagtcggtttttgctcattgcacttggtgctagtatttctttagctgtgaacatatgtgtgtatcccatctgggctggtgaggatcttcacaatctggtgacgaagaatttcatcaatatagctaattcactagaaggtaattcaacctatgagatggttgttactttctcaaagatgggattttagaattgaattgtttcctgagatgggattttaaagttgatgaatttgaaacctttgcaggttgtatcagtgaatatctgaactgtgtcgaatataagaggatcccttcaaaaattcttacctaccaagtggctgatgatccagtttacaatggctacagatcagcagtagaatctataagccaagaggaagctctggtatgtgcttaaacattctttcacatggatttgtaatttcttgaaatttcgcttgccggatgtccttactttggtaccacaggaagcatttgcagtctgggagccaccccatggtccatacaagatgattaaatatccttggaaaaactatgtcaaagttagtggtgcattaaggtattgcgctttcatggttatggcactgcatggatgtatactgtctgaaatacaggtaatttctctactccaatttccaactttcctactagccctgagattgtaaagtgcatcatatagtattctcttaccatatttactttttatcgctggattgcttagtgcctgtttggaagggcttataaaaagtaacttaagttgatggtacactacttttgacttttgacttatttttaaatttttttggcctaaaagggtgctcactttataacctttccaaacacctccaaaactaaaaaactacattaaagtcaaaagcacctaaaaataagttaatccacacgggcacttattctcctaaccagtacaaattttctctgtaaacagtcttttaacaattcttttttgcttctgaaagggggagggggagggggaagggatgaggagatgggtgactgttagcaattgcttctagtattaatcatagttatgttgtgtccctgtgcaataactattcatttgatttactggtgaacttgtgaagtactagtaaaaaattgaaaattgaagttgcttagctcttctattctctgataatatgcagcctataattgttgtgatgtatatcattaccaaacttattatacttgtaataggtgtatatacttcagaacaatcatatattaagattaatatctaaatagggtccttaattgtttgagaatataatttggcattataaatggcatgcatgcatgtaagactttcattaggagatgaatgatttaaaaatcgatcctgtactctctctctggtaacatgtgcaattttcatcaaggagactagatgactggaaacctttttcttatcattcatccattactgagtgatgctactttttgcttccctttaactggaactgcacgaggagatgtatgcagattgatgaaaataaatgtttgaatgtcttcatttccgttcagccaaagtgaagctgaaagaacatggcctgcactctgcagtattacaatctacagaagcatgtcatgtattccctcgtaaatcatcttaggacttagttataaaattaagttgttgcttaagctgtgaacagagttacgaggtaacttttgttgggaggtagcagcagatatttggtgtgatagtcgagttgcatgtcagctaaacctggacaccaccattataaaagtaaagaaaaaaaagttaagttgctgctagatatgcattatatattgatttaatatttgtctggctcaagtccttgcaattcagatgtctcagttataccactttatttgataatgctatgacctctttatcagagaaaaatgactaccaaatattttttacatgtaggcacctgccgaaagaagacaggtttttcgtaatgagcttcagagagtaggtacagcaagtgccaaagtgttgagagaactgggggagaaagtgaaaaagatggagaagttggggtcaggggacattctctatgaagttcatgaagcagcagaagagttgcaaaaaaaggtggatcggaagtcttatcttttcgtcaatgctgaaaactgggaaataggaacacgagccacagcggtggatatttcccaggagcttggaagcatggatgaggacaaaagcttacttcaacatcacaggtctcaaagtgaaacagtcatcaacatagactccatccttgcctcaaaaagttgggataataggacgtgtaacctggctagtaataacaaccaaactacaggagtaaccccagaaaactcggttgggaaaccaaaattccgaacaacacattctctgcctaaagataatgatgcactaaaggaggtggaagcgggggaggatgaagaagaagaagaagaagaatcaaagacatacgaaagtgccagtgctttgtctttagcaacattcacatcccttctcatagaatttgttgcaagacttcaaaacgtagtagactcattcgaagaattaagtgagaaagcaaaatttaaggatcctatggatttgtctgatgcatcgcagaaagttggcttgtggtccaggtttaaagggtgtataaagttttggaaaagagagagcagtttaccagtttagaggccaatccttcttgtccatgcaatgacagaagactatagattatatccttcttgtctgcagataaggagatgttatagcagcttacacaactgggaactcgaatcgtcttggaaatgcaacatagattatatatcctgactctgaaaagtcttaaacatttgaataggctaattgctcctgctggttagttttcaatatataccaacctatcaatgtattgagctaaaattttagcaaagtgttctgggctccagtgcattaaggtctaacggtaaatgtaggtaatagcataaatgtacattgaaatacatctgtttactctaatttttatattgtttattgtggcattattctaaggtgaattgtagaagtgatcatcatggatgtatttggtcaattttcttatgtttggtaagtgaatttttttaatgacttgccaaacattttctcaaacaaagttctacaaatgacttttttcctcagcgacccccgtaatcctacctccccattttcacctctcgtattcgccataattacatattaatttttttttttacatatcaaaaataaatttaaaaaataagaaactcacttatttttttaaaaataatttctaattaaaaagattctcccatcttattgtatcgttaggccatatactaatttattacgtaatcgactaggtatttataaaattttgaatattggtttatcaactcgaggtcactttttaacctataaaaaatgtaccttatagtttttttttccttttgaaaagtatagataatttaagctgtcgaaaaataatgtgtgctaatacatattttcgcgaaagaattgtcaaacatatggattaaaaaaattaaaagataagcattgttcttaagaaaaagatcacttttgaactctctaaagtttgatcaaataagttaattttggatctaaaatttaaaaaaataatagttttaaaaagggaaaatgcacaagtatcttcagattatgatcaaaatttcaaaaatacatattattaactaaactaagatcttattacttctgaacttattattattttttaaaattttgtacacctcttgtcttatatggtacactccgtaactccacataattgagacgcatgggagatatttgaatgtcacataagtccaaaaggtgcacaaaattacaaaaaaaataaaatcaagagtaatagaaccttagtttacacagtttaagggatatttttacatttttcctttacaaaataagaataaacatctttctaaagaaaaaaaattactttaaactttgaccaaacaacttttaaaaaataatagttcaacaaaaaaatctgaagatcaaacgattaaagttgaacct

SEQ ID NO: 433 - DNA, 5008 bp, Solanum lycopersicum; identical to SEQ ID NO: 365

SEQ ID NO: 434 - DNA, 5546 bp, Solanum lycopersicum
atttcattcttttttaaatctcatatgaaataaagctatcgtcgtataaattaggacaaataaaataaaataattttttgatactcgaaaaaaagatgcttttgacaaaaattaaatattctttttttattttgcaaaggggggttgtggggtgagtttagtgggcccaatctttttgaccaaaagctgatacttagtaaaaacacaaaaaccctaattgagtagatcgtcccatcattttacaataatcactaaagtatttccatcattttactaaataaataaaataaaagtcataagcttataaataaataaattaccaactccaataagtaaaattcacttattaatatatatatttttatttatactttgatctatataaaattaaatagacctttgatgctaggatttgaggtcctaatttaaaatcacatttagttagggaaatttctaaaaaaaaaaatcatttttaaattctctaaaaaagtaaaaaagtttcaaattttaagttaaaattatttttaaaatatataaaacttgacctataaatttaaattttacatttttttctttatataagttttaaaagaaaagatcaccatagtatagagattgatcgtaccattttaaaggattatgttatattgatttttataaaattatatctatctcaaaaaatattatcacaaatatttatttattaaataacataaaaataaatactttcttcgctcaaaattaacatctaataatatttggataaaaacaacataaatttttatatagctcatagttataaatatataaaatttcaccatatttcatttgaaaatcatgttccaaaaatggattaataatctttaataaaagattctcttcctttttttaataatcttttttaatgttatagattttgtgttactattattatcttattttattttatcttatatacattgtacagagaaagagagtgtgaatgagtctgaatagagtcctcagatttgcggtaacaattgtaggtatccacctgagttaaagggttaattcaagaccctgttttgtattgtggcctataaatagacaaggtttagttatggcagatgagtgtgctgcttttatgaagggaactgaattgccagtgaagaggccaagagaggaagaagcagaaacagagatggaggcagccaataacagcaacaatggttgtgagaaagaggagtcatctccttatatctcttctgttttacctggatggttctctgagattagccccctttggcctggtttgttctaatctcttgtatagttttttgtttcaagttttctttggttttatgcatctaggtatttaagattctgcttttggtgaattgggttgttattcatatctggttttggggtttattagtctaatgatgttttgtgggaataaaagtgtggatttttttgttatttgggtatctaaggttctggttttggggtttattactgtaatgatgtttgtgggtatcaaagtttggatttttttgttatttgggtatctaaggttctggttttggggtttattactgcaatgatgtttgtgggtatcaaagtttggattttttcttatttgggtatctgagattctagttttgggttattgggttgctcttggtttctagttttggtggattttgggggattatttctctaatgatgtttgtgggtatcaaagtttggatttttgcttatttgggtatccataattctgcttttgagggattgggttgctcttgctttctggttttggtggggttttggggtttattacactaatgatgtttgtgggcatcaaagtttggattttttcttatttgggtatccaaaattctgcttttgaggaattgagttgctcttgctttctgattttagtggggtttattactctaatgatgtttgtgggtatcaaagtttgtttttttccttatttgggtatccaagtttgtctttttgggagattcttggtgggttgaatacgtgaatgcttgtgggtatcaaagttgtgatggttggcgattggtttcagctttgttctgtatgttggatttttagttttgtaaatgttctgtttttgtgggggtaagtgtgtgagcgggtggttgctgtaaaattctcaaagtgagatttggcacttgaaaacttgcctcctatctacttcaggattgaggtctagttttattttctggaaatctagtactagttgtgaacaaaaagggaagaggttactgacaggaaacgaattatgcaggggaagcacactcattgaaggttgagaagatattgtttcaggggaagtctgattaccagaatgtcttggtttttcaggtatttggttgatctactaaggttttagtttcttctcttttttaagatgctgaatgctttattatgtgctgcttgctcatttttgtggtgcagtcatcaacttatgggaaggtgcttgttttggatggtgtgatccaacttacagagagggatgaatgtgcttatcaagagatgatcactcatcttcctctttgttcaattcccaaccctaaaaaggtcagttacactaccatgacttgaaagtattaaatcttgagatctcatatgctttttgacagcattcgatgttatatcctgaggtcttatgacacattgcttatcaagcccatggattagaaattttatcaacatctgttttctgtttgtataattcatccttacaagcttcatttgtttgtttgtttgtttgccctttttatcacattctgcagaaattgtttgtttatttgccccttctaatcgcattctgctgaaattgtttgtttgtttgtctgccttaatgtaattgcattctgctgaaattgtttgtttgtttgtctgccttaatgtaattgcattctgcagaaattgtgtatgaagagtgatatttgcagtcgtataatggccaaaagctattggtgctgtttgtttcttttatttatgtgccaacttaagatgattcttctttcctcaggtgctggttattggaggaggagatggtggtgtcctgcgtgaggtatcccgtcactcttctgtcgaacagatcgacatatgtgagattgacaaaatggtagttgaggtaagcagacttgttgatgctaattcataaaaatggtacatatttggtcttctaattacatgtattagcagtgtctaatggcatattcgatcttagtccagaagtgctactagattttatcctttctctgtattacttgttattacaaggttttgatgagctaattcatgtatttcatgttaaggacatctcatttgtaacttactagctttaagctcttggagaacataatgcgatgttgaaattaagtcttccttctcttccgacaggttgctaaacaatttttcccagatgtagctgtaggatatgaggatccacgtgtgaatctccacattggtgacggtaagatcaaataatgattcttgttatcttctcaacctttctgtttgattctcattttagttcacttactaacatatataagttcttggtgtttcctttttcctgctgttttgcaggagttgcatttttgaaaaatgtacctgccggaacttacgatgctgtcatagtggattcatctgaccctatcggtaatctatcatgtcattgcttgagtactacctttttcatgaaaaaatccagctccctaacagttccactctttcaacttcaggtccagcgcaagagttgtttgaaaagcctttctttgaatctatagcaaaggctcttcgtcctggaggggttgtatctacgcaggctgagagcatatggcttcacatgcacatcattgaagaaattgttgctaattgccgccagatcttcaaaggctctgtcaactatgcatggactactgttcctacttatccaaggtgaacttctattcttatcatttgatccaataaggttccgttgatatgaacaaatttgataaaaaaacaccaattactcaaagatatttccttttcaaacctgctttgaaatacttcacttgttttgctgctgctgttgacgactgtatcactcttccagtggcatgattggtttcatgctctgctctactgagggacctgcagttgatttcaagaaccctattaaccccatcgacgatgaatcccctgccaagtccattgaacctttgaagttttacaactctgaggtatgctgtcattctatttcttggactgaatctttgttactcacatctaacaatagcacttcaacttttgatttgttcttttctttttctctagattcaccaagcatcattctgtttgccatcattcgccaagagggtgatcgaaaccaaaggaaaataatttcgaaggagtgctgagttagttgtactacgccctatagttatcgcagttcttttttttttataaattaaagacaatgtttttaggttatttaagccaaatggggttgaatgatggattataatttcatctttgatataatattctagtttgtttatcttgatgattttcattcactttacattatagagttggacaacattttggtatttcaggcctttgatactgaaatttgcatacaaaactagttactaaatcgaatttgataattaataaaaatggagcaagtaaaagtagtaccttgtaaagttgatatgaaattttactagttgaaatttgttgagggtaatgatctaaaacaagtatagatttcccataagcaaattccaaagctatagacatcgcatttggaatttttgacaattttttttacccttttgactcggcagtccaataaattgcatgcacaaaattaatatgttgtagctaatttgcaaataaacataataaaaagagaaattaattaattacatacctcagcaatattggagttttgaagatggcaccaaatagaaatttcttgtttgaatgcctcgaatatcgatttcttttgtctattgaatccttgtttccatatctcaaatcaaatactttaactaaacaaaaaatatgtgtattaattagagtctggagcataaagtctataaaatattagcaaaaattctaaaacggaatacaaaattttatattaaccaaaatgacaaaatcgctagaaaaagtaaaatcgttataatgtgattttttaaaaaaaaaaattaaagaaaatcgctgcctatcttttaaaaaaaaatttaaaaaatttgcaaaatctctgcaatttgctccgctgttgttccagcaattttgtcattttggttaatataaaattttatataccattttaaaattttattaatattttataccgtaaaagttaccaaaatttcgataaatacatattactttttaagcatgtaatagtaaaattacaatattttagaaacataatcactaatataataaattatactcacatgaacaacaatattcaagaaatataaccctaatatctgtatatatttttactatattcattctaa

SEQ ID NO: 435 - DNA, 7510 bp, Solanum lycopersicum
aacaaagggattataaaacaaagactaattaaaaccccaaaaagtaaatgttaacttaccgtgatccaatgacagttccatgttgatttgaaataaataattaaagtccaagtcaactttttttttttttaattaggcgtccaatatttgtattcatatatgtaattaaattatattcgtgttatgtaagacttcattcgaggaaaagatccacaaaaggcttataaaataattcatacacaccgttcaaatttagaatttataattaagaaacttcatccttaatcagagttcttgggttcgagccttggatatggagaaaatcctgttgagagcgccaccctcaaatgggccctaccatgcgcaattcgaatttaattgaagctctaatttaggctccagacatcgaatgaaaagaaaaaagggggaggaaagtagtgggaaagaaggattacaatttatatttttcaaaattaaaatttgataagagaaacatcagagagttttctacacggccctcagactgcttattaattaaataaaactatatgatatgaaattaggtcataaaaatataactttatctatatgtttggacgggttattcacacgcttatgcattagcttagtcatttagttcatcaaaattgtattttaaattatctcgtgggaaatttattttaaaaatttcaagaagatattttttatttgatacgtcatataaatttttagaaaagaataaataagataattaaaacttagtcgtaatatattcacccatcaatttattaactcgattaatttttacttgttcaaatttaattcgataaaaaaaatatttaattaatattcaacgtttactcctatgtactttttgctcaacatgtcaacaatcttagtcttttgataattatctattcatttctatgagctttttttttatctataaatactcttcataccctttctttctacttcatattaattctatctctttctttttttaacacaaaaagaaagaattaaagatggagattttaagaaaatcttcttctctttgggctttgccaattcttgtgttgtgtttctttatcaacaatggagtatttgttgatgcttctcacaaagtttatatgcacttgcaatctactactagtcatgttgatgctagcaaggtccatagaactggttatcattttcaacctcctaaaaattggattaacggtacgtttttcatgtctatatttttgtttcaatttatgatttagacgttctgagtcgagcataaaaagttttgaaaacatgtatttattcttatttgtatttctttttatgcacaattatatgaaaataatgtttgggttaaaagtcgtgatttttgtcaaatctactattaagagcggagctagaaatttgattttgtccttctgccaaatgcaacagttttaatttgattagtgcatatgcattaagaaatcgactaaatacgtataaaaaggaaaattcagaatttagttattaatacaaaatgatcactattttaaaatgtagaaggaaaaatgcacaaacacctccttaatttatgttcgaaattttagagatttacttatactatattaaggtcttattattccagtgaactttttttataagtaattttctactttcggcggacgtgacactagtttgaaaaaaaaagcgaatcagcgtgaaaaccaaagattgtgtctctaaaattttggactaaggctgtgcattatccaattttgaataaacttaaagcttgcatccactttcatccatggctttttcttgtctttggaagtatctacatatgtacaacctacgtatttatgaataaataaatatgaatagaggaaataatgattagaaatgatttatctaataattatttaatttccagctgattggttaggttgactgaaaaagttaggctattttgatactatttgttataataataatactctgacagcttttgagttaatgaaactacatgttgcccatgacaagtagattcatattgtaattaatacaatattgccgttctatagatattagaagatttgaaactaattttgttcacatcagcgatcaacttataataagtcaaacttaggtgacagcctgctatattttacttatatgtagaagaatttttttttaaaaatgaaatattaatctaatatgataaaaaaatgatcgtataatgatggttagaaaaaaatcataagtatattttacatcgtcggttcaaagaattcttactcatagaaaggtttatgatgtgttttttagtaacagctaatacgcggtcaactttaggctaacgtgagaaaatgaacttaatgcatgtgtcatgtgatatcttttgaataaaatattgaatatacatttatacgaagaacaaaatagagtttgataatataatatatatgacgattgagataaagtgttaacactttcattcttaatcaagagatttcgactttgaatttatttgaatacagagtaaccttttcttaaggaagcgtttaactcgaaatgggattttcagacgtaaattttaatttaatcgatttaccagataacgaatgaaaaattaaaaaataataataataatataatatagtatagtcaactccacctcccacccccaaaccaggtgtggtacgtgggttggtggtagaatctgaaccaatcgtatatataatattatttatattatagtatatacatatacaaataaaacatgtgaagagcccaaaagtacgtgaaatatatagagccaaaatgtatgacgtaaagatgaaaagaaatttaaaaaaataaaaatatgaattactctatacatttgttatgatttcattagttctcttgacagttcagtttgtgtaattttaaagaaaaaaaaggatagaaataatgtaacaataataaatatagtccttgttgttactatcatgatcaatagaaaaaaaaaaacaattagaaaatgactttttttttcttttcgtttttttttttttgaggaataaagaaaagtcaaaatggtttggacaatattggcaacttgtagtaaagtctttggtcttcgggcacgtcatttcactttatttaattttcctctttatacctatttgtttctgactcgacggattcaggattttaaaattcacaaattatactgtaaaaatgatttaaaaagtttgagtacgagtttttatttaaattctatatataaattttaaaaatttattatgtatttgattgtgaacatatctagttattattatagtcgttctgtccctttttacttatccacttttgaattggcacacctattaagaaaataattaatgacgtagtgagtttatcattttacctctattaattatgaagtgaatgaaaatttttacatttttcaaagtaaaaagttatttaattgtgggtttaataggtaaaaaattatcctttcttgatttgtcaaattagacaagtaattaaggacaactataaaaaaaatagacaaataattaagaacaaaaataatattataaactgtactcatcgtagaaactcatggaaatttattaagtatctataatttttcgattttgaatgaattattcatacatattaaatatttagttctgttgactcttaacttcaatagtatatttgagttttctttacgaataagtcataaatttttgtctctctttaatttgcccttttttccaatagaaaagaggttgtgggccttgcatgagctggttccctttagaaacttacaaaattaaaaatattaaataaaataaaatagggtagatttctatgttgaaaaagaaaaaaaaaacactcaaaactttttatatttcctagatttttttttgtatttttagtgacaatgaaagcccatccatcagaacttcaaaatacgtgcattaaatttttgaggaaattacttggatagatgtcttttaataaataattacttattttagggatatttttaatttatttactatttatagtatttgcaatatgtattaaaagtgaattaagtatgcgataatatgtattataactattttataaaatatattatacatgtttggtaagaagttgacacattaaattataagcgtattaaaacgtgaaataaatatattatctatcaataaaacttgtattatatgtaaataataaattattttttgtaatatgaattaaaagtgtattattcaaaaatatattattgctataaatgataaatattttttatttatagtatatttacgtaagtttcccttaattttttcatctaaatattaatttagttggatgatccatgttaccattctagtattcttacattttacatttttataagttttaatatatattccaattgcattttgactaatcaatctcaattttgttttttttcatgttgatgcttcaaacaaacaacagatccaaatggtgagtcaaaaagtttaatactttttactaaccataagtaaatttaatttttacttggtagtaattatcacttttgttctccataggtccaatgtattacaacggagtgtaccatctattttaccagtacaacccaaaaggagcaacatggggcaacattgtttgggctcattcagtctcaaaggacttgatcaactggatcccgctcgaacccgctatctacccgtctaaagtatttgacaagtacggtacatggtccgggtcagccacaatcttaccaggcaacaagcctgtgatcctctacactggaattgtggatgctaacaaaacacaagtccaaaactacgcaattccagctaacatgtctgatccatatcttcgtaagtggatcaagcccgataacaatccattgattgtcgcggacaaaaacataaataaaatccaatttcgcgatccaacaacagcttggatgggcagagatggatactggagagtattggttgggagtgtgaggaatcacaggggaaaagttataatgtacaagagtaataagaacttcatgaaatggacaaaagctaaacacccactccactcagctcagggtactgggaattgggaatgtcctgatttttttccagtgtcattgaaaaatgaaaatggtttggacacgtcgtacgatggaaaagatgttaaacatgttcttaaagttagctttgatgttacgaggtttgatcactatacagttggtacgtacgacaccaaaaaggataagtactttccggataacacttctattgatggatggaaaggattgagacttgattacggtaattattacgcgtccaagacgttctttgatagtggcaagaatcgtaggattttattgggttgggctaatgaatcagatactgttgataacgatgtgaaaaaaggatgggccggggttcaccctattcctcgtaaaatatggcttgatcctagtgggaaacaattggttcaatggcctgttcaagaattagaaacactaagaaagaaaaaggttcaattaaataacaaaaaattgaacaagggagaaaaggttgaaatcaaaggaatcacagttgcacaggttagggattgatttttttttctctccttttgtttcatttttatgacttatttgagacgcgagttaaaaatacaaattatatttgaaaattacaggctgacgttgaagtgatattctcattcgcgagtttagacaaggcagagccatttgattctagttgggctgatctttatgcgcaagatgtatgcgccattaaaggttcaacggttcaaggtggtcttgggccttttgggcttctaactttggcttctaaaaacttagaagaatacacacccgttttcttcagagttttcaaggctcatgataattacaaggttctcatgtgttccgatgcctcaaggtatgttctttcatcgcccaaaaaaaaaaagaatgtgtcacattgtcattcaactacaattgaatggtttgtttatctttttccattgatgtcaccaggtcaagcctaaagaatgaaactactatgtataaaccatcatttgctggatacgtagatgtagatttagcagacaagaaattgtctcttagaagtttggtaagctctcatctcaattctttgttaatttttacctatttcatacgaatttcgcgtgttttaaaaatttaattatatttcagattgataattcgatagtggaaagttttggtgctggaggaaaaacgtgcattacatcaagggtttatccaacgttggcgatatttgataaagcacatttattcgccttcaacaatggcgcagagacgatcacaattgagactctaaatgcttggagcatggctaatgctaagttgcactagaacgttttttatcttattatgccacgtcacaaagaaaccatagtatagaaatttaacttgcagttattcataaatgatgcaatttttttaaaatataaaaatcttgtcatatattgatcaaatgtctttgaattaagagaatgagtatcttggtgcaattttttttcattatgattgatatattaaattcggaatgattcgaccgtcttctatcgttttttaacttaaatattgtattgggcttaaactcgtgacataagacacaagtccctcggtcttgaactatattgaacaaaagataatgtaggtgtaagaacaacaattaaaacttaccttaagcctaagaatgtttctcaatgaatttttttacattaattttcaagcttggcaactcttacaagttctcaatatctgtgtagagaattcatttttcacttatgtttgtcttgaaaatgcaagacaactcttcttatttatatattggttgaagacttacgaagcctttaattatcaacaggctctctaaacactgaacagttaaattatcaacaggctctccgagttactcaagacctagcaccccaacctaactcgagtatttcctaataaaattggttcgggggtttgaccaacactatcttgtccttgaaccatcagatagcattgtcaattcaattaatccggatactcttttaaccctgattctatatttacttcaccaaaattgtcatttaaattcatagtcaagaagtaataatttggttaacatgttacttttgttttcctcctttcaaacataaaagaaaaattcaaattttgctatttgatatcatactcgttttacttctatttactatggacaatgttggtataggaagcttaaattcaacctagcaactagccgttcacaggcctattttgatgttgatttcatgtgtgtttgatcagacttttgttctatcaattataaattaccataaatacatacattaactccaagtttaatttgagtaagaaccacattaacagcatgtccattgctaacattacaatgttattatcatctcaaaatccaaaaaactagttatttttcat

SEQ ID NO: 436 - DNA, 4858 bp, Solanum lycopersicum; identical to SEQ ID NO: 295

SEQ ID NO: 437 - DNA, 22380 bp, Solanum lycopersicum; identical to SEQ ID NO: 297

SEQ ID NO: 438 - DNA, 7670 bp, Solanum lycopersicum; identical to SEQ ID NO: 300

SEQ ID NO: 439 - DNA, 2994 bp, Solanum lycopersicum; identical to SEQ ID NO: 225
  modified_base (2655)..(2994): a, c, t, g, unknown or other

SEQ ID NO: 440 - DNA, 4272 bp, Solanum lycopersicum
atcaccataaaagaacaacaattttctatgtatcttcgtttgttcttcttttcttccttttttgatcttataaagactctttatatagttgtatgctaggatttttttgatcttataaagactctttatatagttgtaagctaagattttggggatattttagtcttcaagtaattttagaggacctcagacttgaagaatacgagttagacttgtttagccaacttaattgatcgatctaaatgtaattttgatttaagtattaatttaaactttattaatcgctaatttaacttgatcaatatatcataaatttataaattatttcaaatttaatatgaatatatcaataaaatttcacaaatctacaagagtcttagtttcatttgttctcttttcaaaatgcttatttattttccatagaggtcaaactctgtctgtatacatctactctccctctccaagttctcgtgtcggttgaatatcttttctctcttgattgtcgaattataattttatttaaattatacatttattacatttatacaataataaataatatttattctattattgaaaaataaacaatcataatcactcaatattcaaatttaaatataacattttaatcatttaaacatacaattaaaatctaaaaaaatcgatacaatctcgtttaacacgtataaatacgctcacaaatctaggttctatacaaatggtaatttacatctgtgggatataattaccatgggctcgtaagaaaaaaaaagattaccatcttgatttttgaatattccaaatcaaccggctccgccaggtttatttcttctcactttctagaagtttccgacggttcaaaccatgcgttgctgactcggcatttcatttctttttcaccaagacaaccactactcacgtgactttcccctcactagtcacgtgactcctccctcccctaatactcctttatattccgcactacagccatacatttcttgctacattgactgtggtttacaccataacctaatttctctctcttacatctttgcttaagctttcatactcttttttttcttagcaatggcaaacggaaagatcaaaatcggaatcaacggtaactcttttctcatttttatgtttaattagtcggatctgcggatctgcttgtgtttggtagtgtgtgatgttgattttttgtttttcaatattattgtttgaaataggattcggtagaattggtcgtttggtggctagagttgctctacagagagatgatgttgaactagttgcagtgaatgatccatttatttccactgattacatggtattgtttgttgatgaccagatctctttactcatttatgtgcttagactagatctgtagaggggattaacttggatctgtgtggttggtgtagacatatatgtttaagtatgattcagtacatggacaatggaagcatcatgagctaaaggtcaaggatgagaagacacttctctttggagagaaggctgttacagtttttggaatcaggtattttttttgttccagtgaataaatcattgtgtttagttcagtttagttttttgctgaagggatttcgactattgttaaggaaccctgaagatatcccatggggtgaagctggtgctgacttcgttgttgaatcaaccggtgtcttcactgacaaggacaaggctgctgctcacttgaaggtatgtgtgattgattgatttttctatctgcatttctgttgttagatttgatctatgatgcacgcgtatttttgaaacttgttgaatatagttatgaaacatcttagatcttgtttgtcagtgttagatctacatttgccgagaaaacaaagcgaattaatttacttggatgtttgtctgttcagggtggtgccaagaaggttgtgatctctgctcctagcaaagatgctcccatgtttgttgtgggtgtcaacgagaatgaatacaagccagagctggacattgtctccaatgctagttgcacaacgaactgccttgcacctttggctaaggttatcaatgataggtttggcattgttgagggtctcatgaccactgtccacgccatgactggtgagtcttttcgcagtcactgtgagatttggatgtgtttgaattttatatctagttattaacctgttgtaatgatttgttactcagccacccagaaaactgttgatggtccatccatgaaggactggagaggtggaagagctgcttcattcaacatcatccctagcagcactggtgcagccaaggtagttattggatatatataccagtgtcattactttgacttgttgtctaatttgcaaattcatgtctttcagtaatgacagagctattagacttggtagtttgtattatctttgatttagttgcattcactataatgtaggctgttggaaaagtgctcccacaacttaacggcaaattgactggaatggccttcagagtaccaactgctgatgtctccgttgtcgatcttactgtaagactcgagaaagaagcctcctatgaagacattaaggctgcaatcaagtaagtttcagtttgatcactttgtgttgtttttggttggtcccttgtgcaacaaagactaacctatttgtgtgttgttggttcatagggaggaatcagagggtaaattgaagggtatcttgggatacactgaagatgatgtggtttccacagactttgttggtgacagcaggtaatatactttgttcagttcactcataagggggtcgtcttgaattgtatttgagtttagtttaatgtgaaataataacatttggtgtaggtcaagcatttttgatgccaaggctggaattgctttgagcaagaattttgtgaaagttgtgtcatggtatgacaacgaatggggttacaggtaatgctgtgtgcttttagctttttctctttgacacattgacactagtgaagttttaacaccaccatatatgtatgtattatgttttgcagttcccgtgtgattgatttgatctgccatatggctaaggcttgattgatgctgctggggagcaaaagacagcaatgtgttttagtttttgcttggaagtactattagttttgtgggcctggagtggtctttcttgtttatgtgtaattgaataaccagagaagaacggaaccctgttgttatctttgaggaaatcttttttattgtttgactttgtcatgaatgaaacaatcaaactttacttttctcttgccttttgttatcctatgtgttctacacatccctcctattttcattgaaatatcttttcttatcttaattttaatattccaacttggctacttttgttagatcgacaaacaaattcagttcgacttcaaaatctacaattttattgaagagtaagaagaatgcataaagaattgaagcaatttttgatattttcatcatttatataggaaaagggacaaaaatagccataagtctgactagttttaataatatcaagttattgtcccctggccatttgcaaaattatcatcaccgctctatcggatggaaaacctcaaatcaaaaaaaaatattttcttttaatcccaacaatggctctccgttgacgttcctcatgtgaatagtaacacgcgaggcctttgaaaaatagagattatgctttatttatttttcatttttcattcaatgataatggagtttgattattttgaattcatatattccgtaagttctcatttgacgaggatataccaaatttgtttggactatttttcaaattctgttttctactcattctcttctttttggtatcatgtcaacggtagatatctatattgaattgagagataagtgttaaaaatacacttaaactattcactttttttgagtttgatatctaaactattgaaagtgtgaatttcatatttaaactatcactttttagtttgagaaacatggtgtgtgtagtgcactctctcttttatatgaaaaaactttgacacattacattccacatagataaaatattttatttagataaaaattaaataataaaaaattaatattaattaaaaattaaagattactatccatacaaaaaattaaattatttttcttatctcactccatcacctcctccacgtaccccctccccgtgacaaccccatccttttttaaaaaaaaaaatcatttataaaatatttttaaaaatttcatatttcatcttttcccctccc

SEQ ID NO: 441 - DNA, 5367 bp, Solanum lycopersicum
ctataaaatactatattctcatttcaaaataaatgaacaattaaatctttttatataaattaaagtaagtgaatcattgagtatttattttttaatgtataattaatttatatttaataaaagtaatttgacaaaaattatctatattcattttttaatttctttatcaagtgaataactatttttgaacataatattttaagagacattattcttatcacaatcatgacaaattcattacttaaaactatatcttttaaataataataataataataataataacaataatgtacgtccatgaataacaattacaactattttcatggtcaaatgtttaatatatttttagtttcatattgtttgacctaatattgagttggtataatctttaaagattttttttataattaaaatagtaaattatacaaaaatctgtcaactagcctaaaatattattttttatttaaatttatatgatataatttatattttgaattcaaaaaagtctatttttgattgttaatttttttttatatatattaattattttgagttatcaattattgtaacttatataacagtatttttctaaaattgtttgacttacgtgtcacacataaattgcgacaataaaaataataaatgtatattctaattgttcctatttttatacatcgtcttaataaatagatgatccttaaaatatttatcaatttataaaatcaatgcatagattattattttttctttcaagtttacttttaaaaatttcagccttaaaaatatgaatttgattggtatagaacaatcgtattacataataataatatatttaatagtaataataaagtggaaataaacaaataatttttttattttatctaaatttgatagatgtagtaatgtaacgatagtgaaaatcctcaacgaccgcatacttcggtatccggtcaccaaccagtttatatttaaagccttcatcaccaccaacaactccactactctgttctacaaaactctgcatcaactcaaatacacacaaaaaaaatcaatgggtatttcgattctcttacctctttatttttacttgtttctattagcatgaatctctctgtttagattatgaacttccattaatttttatttgtttcttattctcacagctaaagttaagattggaattaatggtaagaatctgttcaaattgaagtgaatttcatctaggttgtttggttctgtatttctataaaattttgaaatcttgtttttcatgaaggattcggaagaattggccgattggttgctcgggttgctctccaaagaaatgatgttgaactcgtcgcagtgaacgatcccttcatttcagttgattacatggtatgtgcccacaaaaaaaacccataaaacgaaaaactgaatgattttattgataatttagttgatgggtttgatttgttggtgtttcagacatatatgtttaagtatgatagtgtacacggccagtggaagcatcatgagctcaaggttaaagatgagaagactcttctctttggtgagaaggctgttactgtttttgggtttaggtaatgttttacctctttaatatatatttgctaatcgttttacaattttattgggttgatttgaatttctaattgaactttatttgtgtatctgaaggaacccagaggaaattccatgggcacagactggagctgattacattgtggagtcgaccggtgttttcactgataaggacaaagctgcagctcatttgaaggtttgtgattataaagaagtagattaactgaaattccttgttttggattacaaggaaaagttccacgaatttgtgcgttttgtgtcaccgtgtgtatgatgatcatcaagtttcgagtttatgtgctttcatacatacataatcactcagtattagtgatgttaattgatgtttgatgtgtgtcttttattgtacatgctgatatacaaattttgtactaaggtgatgctaattgatgctcatagtttacttgagttttggtgagcacgttagtatataatttaatgatattgcttactctgtttcagtttgtttgtcgtattttcttttccatttttagtagattgcgtgtcttcttttttaacaattctttaatcctaacttccacatgatacttttaagatcacaagatcagaaagtattttggttcattatacctatttttaattttatgatcgcaacattcaaaagttctttctttattttcttaaatttcgtgccaagtcaaacggatacaacaaattgaaatagagggagtatgaattataagtattttcttgccaaggacattgattttttgatcaatgtttcctctcatgtttttatttaaatttagaaaagagaattaaatagaacatatctctagatcaaactttgatatctttatgcttgtttctgttaatgacttaatgctacaagagttggattaattgactattttcctttctggccttgcctctagttattacttcagtgattcaagagagctaatatctgctcgatttttatgaatcatcagggtggcgccaagaaagtttttcctttctggccttgcctctagttattacttcagtgattcaagagagctaatatctgctcgatttttatgaatcatcagggtggcgccaagaaagttatcatttctgcccctagtaaggatgctcctatgtttgttgttggtgtcaatgagaaggaatacaagccagagctcaatatcgtttcaaatgctagctgtaccacaaattgccttgctcccttggccaaggttctcctattccaccaacccggttccttcagattaactattgtctcatttcataacgtgaaacgcgagaatgagacatcatctcacaatttatcatgcaaatgtgcaggttataaatgacagatttggaattgttgagggtctcatgaccacagtccactccatcacaggtaagtgtctctcttgcttctgcttttagataaatatagttcatttttagcttgctcactcggtttggctaccaccataatatttcagccactcagaagaccgttgatggaccatcagccaaggattggagaggtggaagagctgcttcgttcaacattattcctagcagtactggagcagccaaggctgtggggaaagtgctaccagcattgaatggaaagttaactggaatggctttccgagtcccaactgttgatgtgtccgtggttgacctcacagtcaggttggaaaaagaagctacctatgatgaaatcaaagctgccatcaagtaagttgtgctttttacatgatttttcttaagtgcattagtatgtgcatcattttccctgtacctaaagaatatatatcacatatctatagcgtctagtaatgatgtttgcgttttttcatattttttttcctggagcttagtgttctcatcgctcccgctaacttgcactgttttattttctaaagggaggaatctgaaggaaaattgaagggaattctaggttacactgaagatgatgtggtttccacagactttgtgggagacaataggtgagtttgtgacattgaactgttctatgatttaattcctgtctatttcgtgttgcatgagctcctttgaagttcttgctcaaacgttatttgtgctgatccactttgtcttgcttgaacctttgtctgtgctgatccatttttatcgtgctctattaatcaagacactgtatttctgcatggaaataatttgcagatcaagcatatttgatgccaaggctggaattgctttgagcaagaattttgtcaagcttgtagcatggtacgacaacgaatggggttacaggtaaaaaacatgaaatatttactgtacatttctttcatcaattcagttcattggatgctgagcacgaatgccgagcataggagtattatatgatttgtggcttcctgctaatagtaatccttgttggaattgcagtacacgagtggtggacttgattattcacatgtcatcagttcagtaaatgtggcagttcactcgttggtggcgctgctggtgatgatcctgttcttcgtggttagataaaatagcttagaataaagtgttctctcggaccacaaacgcgcagatgtttgatgtactttggggctatactcttgtttagatgttcaactggatagtaaacctgttcactttccgagaatgagtcttagtaactctggtatatgtgttactcttgtttcgttctgttatgaatgtataataactttgaaccttgtttagtaatcttgcttccctgtttctatacttagccaacaggtcccaaaggtgaattgttactctgcaattatctgttctttccgggcagttttccctttcttcctgtagtacaaaggggagtttgtcatgctgtgtttctaatttctcttactaataaatgcagtgaatgggaggagggagaatagcagatttcatgtgaatttggtttagctggtttttgggatcacaagaatgtcaataaatttgataattgttggttgtgagctttaacaactactagttgaaaagctggtttttgggatcacaagaatgtcaataagtttgataattgttggttgtgagctttaacaactactagttgaaaagcagttgcgtggtaggcgagcctgtttgtatggcttattttaagcccgttcaggagtgtttcgataaaataaaaaagtacttataaatatttatttttaagttaaaataacaaaaataagtcgaaggacttcagctaccagtcttaccgatactcttttatttagctggttttccttctcgtggcaggacttaaatgcacacactatttgtccatttaaatttcgaatttgaaagtggggaatacgatacctcaattggacaagaaacagtagaaaaagacaagaaatctcttgaaataaatttccacaggtggctgatgaatccatttccatttcaaattttgaaaatgaggacatttatttttcctgttggcacaataattgttcttagtactctgatttcaagtggcctttgtcttataaaaatagctgcaccaccaaatgactattgtcttcgttcaaactatataatatttaatttgtcaaatctcacaattgcattaacaaatgaagatgaataaacgtgggataataatatgagatgaaatcgcaaggatgactaagttggtacgttgcttgggctgcggatttcctttcactattgtgaattgtgatacaaatttgatacagtattttaatgtggactaataggtcattaaactcatccattttcaaattt

SEQ ID NO: 442 - DNA, 3286 bp, Solanum lycopersicum; identical to SEQ ID NO: 312

SEQ ID NO: 443 - DNA, 4166 bp, Solanum lycopersicum; identical to SEQ ID NO: 237

SEQ ID NO: 444 - DNA, 3396 bp, Solanum lycopersicum; identical to SEQ ID NO: 392

SEQ ID NO: 445 - DNA, 4472 bp, Solanum lycopersicum; identical to SEQ ID NO: 253

SEQ ID NO: 446 - DNA, 5151 bp, Solanum lycopersicum
ttgttgaatattcgataaattcataccatctgtttcaaacaagattcatcccttggacatacgaacaaccgtctttaatcacatgcttgaaaataattatgtatgatcacgaagaatttcttgttgaatatttgacaaattcataccatctatttcaaaaaaaagattcatcccctgaatatatgaacaatcgtctttaatcacatgcttgaaaataattatgtatgatcacgaagaatttcttgctgaatatttgataaattcataccatctatttcagacaagatttattccccatacatacgaacaatcgtctttagtcacatccttgaaaataattatgtatgatcacgaagaatttcttgttgaatatttgacaaattcataccatctatttcaaaaaaaaaacattcatcccctgaatatatgaacaatcgtctttaatcacatgcttgacaataattatgtatgatcacgaagaatttcttgttgaatatttgataaattcatactatctatttcagacaagattcatctcccagacatacgaacaatcgtatttagtcacattcttgaaaataattatgcatgatcacgaagaatttcttgttgcatgtttgataaatttatatcatctgtttcagacaagattcatcccttggatatacgaacagtcacattctcgaaaataattatgtatgatcacgaagaatttcttgttgaatattcaacaaattcataccatttgtttcaaacaagattcatcccctggacatacgaacaatcgtctttaatcacatgcttgaaaataattatgtatgatcacgaagaattttttgttgaatgtttgacaaattcataccatctaattcaaacaagattcatccctggacatatgaataatcgtcttgtttgaattcaagagtctactattcaataaaaaagtttcaaatttaatcgagatctaatatgataaaagaaatacagatgtcctcgttatcacaaatgaaagttttgacaggctttttttgttgccaataaatagtgcccacacagtaacacaccacaactcctaatttattttctccgccgtagcttttaccttttcctcatttcttttgtatattccgaaatgaggacctccatgttgaaatccatcgtccgccggagctccactgccggagcatcctatgtatctcgccgtggattcgcatcgggatccgcgccggagaggaaagttgcagttttgggggcagccggagggattggacagcctttatctcttctaatgaagcttaaccctttagtatccagcctttcactctacgatatcgccggtactcccggtgttgccgccgatgttagtcacatcaacaccagatctgaggttgttttctactctctctctcccttacgttttctacttggaattctctgtttttgttcattttgtatgagtattggcgaagattactaatgaggatttgtattaactaaattggaactaagacgtatctggtaggttgattgattctgttaacatgcttttttgatttcctgaatctcgagctccgatccgatttacgttagtcgatttcactagtgagtttgagtttgttgcttgcttcattccactatttagtctatttttcgagtgtgtatcacataagtacatatagattcgtgaatgagttactaaagtacaaggttttgtgctgaaaactaggtgtttgtcagcaatgaagagttcaacaccagatcattttactctttgcatcagttgcctgttttaatttcaagatgatttgattacaatgttgttttaggcgtccactgtcaagtagttaacgatttgaagcccatctaccttttgtgtcctaaacccctctaaatagtgtttgtgccagtttatggttttctttcctgcaattctgatctgtaaatatatttgtggactttgcaggttgccggttttgcaggagaagagcagctagggcaggcactggaaggagctgatgttgttatcattcctgctggtgtgccccgaaagcctggtatgacccgagatgatctgttcaacattaatgcgggtattgttaaatctctatgcacggccattgctaagtactgccccaatgtgagtatgcttgtgtaattatctctgtatatgggggttatatataggagattctagaaaaagtttctgattaattttctcatttgctgcttgttctgataacttaaaggctctggtcaatatgataagcaacccagtgaattccactgtccctattgctgctgaggtgtttaagaaagctggaacttatgatgaaaagaagctctttggagttaccatgcttgatgtggttagggccaagacattttatgctggaaaagctaaagtaaatgttgctggtgcgcgtcttcttgtctaattctttatttgaattgattttgtttcgctttacatgaaactgtaaattcatacaatactatctgtctactttacttactttttgcttcgtttttcagaggtcaatctcccagtagttggtggtcatgctggcataactatcctcccattattttctcaagtaatttttcttttcttgtcccttgttataaagctttttctttttttagtatctattattatcttctttatgttgtaagtgtttgattgaacattttttagtatgtattatctaaattgttattggtgatttccatattgtggcatattgagtcttgtttttatcactaaattttggatacaggccactccaaaggcaaatctatcagatgaggaaattgttgcactcacaaagcgaacccaagatggtgggacagaagttgtagaggccaaggctggaaagggttcagccaccctctcaatggcgtacgtttccacttcaatgtttttcttgatttatttttttttcctgaaggattttcactttgattgcaagattttgtttacgaataagttatggtgctgcccaatgtcacggtcaaatatttaggaatgtagagaaacaaacaaaaaaagaaacttttttgacatatactgccccaaaccacttcatttactggcctttcctgtttgcatactcggttctaagcagttagttttacttgtgcagctatgctggggctatttttgccgatgcttgcttgaaggggttgaatggagttcccgatgttgttgaatgtgcttttgtgcagtccaatgtcaccgagcttcccttcttcgcatccaaggtaataagccttttcttttcctacaaagacactggacgtcatgtatacttttttctttgaactgtctgattcatttggtcattgccctcttatcatgtgggtatgaaaaggtcaaaacaaattatatagttcaagtttaggtttgtttaagcatgtctgaagctgtgtctattctggatgtgttgagggatagttttgacatcatgagtcatcgattgatcttgattaagcatgtctcatgtggaatggttggtagcttttcaacagtgcaagtcgaatgtgtcaagaactaagttgacatcctaggttattatttgttgttagtcacacacgcatctgaacgtaaatagctcgttaactttgaatcatgggctaaatttgtacttcctcttatcaactgacttgtgggtaattcactgtataaggtcactattttcattttgcttacttatacatgtcattcaatttgatcgctttgcaggtaagacttgggaaaaatggagtggaggaagtcctagggttgggtccacttaacgactacgagaagcaaggacttgaggctcttaagccagagctgctctcctccattgaaaagggaatcaagtttgccaaagaaaactaaaaaaacaaaattatggtctagttttctatagtgacagttttggatctttttgggtcaattgtttttgtatcctttgcaagtttcttgcagccggaggcttagatttagctcttttgatattatacccaacatttctacaaaataatgtatggcaaactgggggcctatcccatttgccttagtgtggaggtgttattctcacatgaatcgttttccaattatggttagtagcagacaattgatgcaaaatgaagaaatgttcatgaccaattactgcatcgttttgcaattcattaaccattttctgtcgttatacttttgactatgacaggagaagccaagagggtgttataaaaagctcaaaataagcaaatgcgtcagttaataacttgccgcatattatgatgccagacaagaaattgagaaagtatgtacaccctcctactgttatttccatataaatccctgatggtgatattacaatgcaataaatactcccaaagcaaacaaacaatacacatcatcagcctattatgctctttgtacatccaggttacagctgcaggaccttgcatgaatcatgatcctgccaaattgttgacaatgacactgaaaacatagattttttcagcacacaatattttaattcaacaaacaggtgttaaataccctcacagtactaccaccataaccacctccctctgtatatagcttgtcgatgacaagctatatgacagagaagaatgtgagcgccaacagctaacatgctcccaaattcactaggacttcacttcctcccatacttgaagttcttgaaagaaacttatcatgcaagagccacacgacgtctttcagatgagtgtttgaacagccgtctgctctgatgcattcataatccaaatttcctgcaataattataagagacagatttacacaacgcttcctcatgataggcaagaaacattttaaaatataaggcaaagaaacatagaatatacagagcatcaagtagtagtcaatgaaagttcctcaaccaagttcttcgtttcacataattactccgccacagtttcagagacaaattcaaaggggaaaaaagcattacaagcaaaaaaaaagggtaacacaacttatcttctccttctttccactataacatggtgtccctaggtgcatgaaaaaaccggggagccacaataacagagtggatagaggatataaaggaaaacaacagtagttcctagttctagggaggggaaacttgctgc

SEQ ID NO: 447 - DNA, 4919 bp, Solanum lycopersicum
ctataaatctttttattgaagataaattagcattttaaaattaaagtgttactaaatattgaaatataagattcttttgaaatgactaaaaaagaaattaagtcatataaattagaattggagtatgatttataagtaaacaaaaaaatcataaattaaaatctctaacttgtgattttttgattcattttggatgaacaaataagtgcttaaaaatatttttccttccgacccaaacattacaataatacttaaataacacattttaactttaagggttgttttattgcgaacgagttattatgaaattaataatcatagaataatttattttatcagatgtatgagataatttaaatcatcattatggtataaattttctgataataatctaagaattattcaatacctccaaccagacgctcagtaaaataaagggaaaatacacaagtaccacttcaatctatacccgaaattccagagacacacttatattacactaagatcctattacctcattgaacttattttataagtaattttcaaccccttttcgatctacgtgatactagcctgaaaaaaaatcaatcagcgttggacccacaagatagtgccacttaggccgaaaaggaaaaagattattaataaaataagttcaagggggtaataagaccttagtatagtataaatgtgtctctgagatttcgggcatagattaagagatacttctacattatccctaaaataaactcacattttattttaagatagtattataccttatattttacgccaaaccaaacgactttttaacatgctaattacaagcataaatacccatccccatccattctctctgctgctcttgagcttttttggcatttcattttgtaagaaaaaagagtggaggggctaaaaaagtatagcgatacacaaaaattatattagaaaaaagatcaaaaaaattgacaagagcaataagaaaatcaaattaaaaaaaaaaagatgggtagagctccttgttgtgagaaaatgggattgaagaaaggtccatggactcctcaagaagacaatattctcatatcttacattcaaaataatggacattccaattggcgtgcccttcctaaacttgctggtaattttgctctacaaatctatatttttttcatatcacttctcgaattttaatctgagatctctgattaaacacgagagattatatctaatatcatctgaacttgttttagagtagaaatcatgatttgatcaattgaactacaaaatcgtcgtaaagacaattttaagttagcatttgattataaattttaaaattattcatgaatatttgtttcatcttcaaatatttttaagttcccaaaaactgattcgaactagttttggttttttcgagaattttcacttaacaaaattatatttttttcccaaataaattacttaaatttttaactttctacgttaaaatttatgatcagatttaatcgatttctaaagcattaattcttatctcttggattgaacttttcttgagatgttaatttttaacacgtgaaacatgtcatcttttatttggttatttcctttttttcttttttcttttacttgtgaaaggacattttttatttattgaaaaataaaattactggggattattataaagtgtaattaattttttttattctttttttttgattatttaggactattgagatgcggaaagagttgcagattgcgatggactaattatttgcgtccagatataaagagaggaaatttcaccaaagaagaagaagacactataatcaagcttcatgaaaatcttggcaataggtcagtatttttttcttaaaaaataaaatttaattgcaactaaaaaataaaaataagaattagttaagaatttaatcactagtcaatttctaataggcttgtggctgccaattttgtttaataattcacggtaaattataaatttcgtgatactgatactatctttaaattatagtaatataaactttcactagatatgttattattattgttaattaattacggagtgttgatcacatctaataatgcgtgcctagagtcgtgataaaaattagtatattaaaataaaaacacattttccttttattattatatttgaaaggaaatatataccttagcttgtgaattatttatttgcaaaattttttgtctttatattcaggaaatataatactttttgagaattgaaaaggaaagatttatattaagccaaaataacacttattttattttatttgtcattttgtttctaccaatgaataaattaaataaatattataaatagagagggggaaaagattctcttagacaaattggtaattaaaatatctctaataattaatgtcatttgccaatctacacatctgaatgaagaaaatctatgcatatggctaatatctcctttgattttagtgacactataattaaagtttttgcactatgtcatgtttgtccacttctctcaatctacaaataatttaacttaattacaattgataattttattttaaaatgttacaataccaatgtattttaataagagaaaatcgataatatataaatggctattggtttaagtgcacctaggtaatagcttttgcttagaactattgtatatgtattttttttaaaaaaagcactaaatataatttataaatatagctgagttagtgcaacacatgactaatatcctaaggatatagattgattccttgtcaatattttctagtagaattaattgcatcgttacttgacttacctaatgcaattaatctctggcatagtttataagctactagatagaaggagaaaataattatatatttaaaggatatcgactatagattttttagaggtttcaaaagaaattacttaatatagatgtataaatatttgattgaaaaaaaaatcttagttattatgtggattaacttggatcactataggattccaaaaatttcaatttcaaaattcgtttttgactttatgttaaaacttgtattgttacagaagttcataaattttaaatttttgaaccagtctttaattttaatgtgttgttatagataatgtacctcttttgtttcaacgttatatgttgacctctttctgataaaatttttccccgaaataagcagatggtccgcaatagcagcaagattaccaggacgaacagataatgaaataaaaaacatttggcacaccaacttgaagaaaaaactcaagaattatcagccttgtcaaaattccaaaagacactccaagactagtcatgtttccaacaagggtcctacaacttctgaatcctccaataactctgatcttagtacaagtactaaacaacacattaagattgcacctaactcaccacaactttcatctagtgaaatgtcaagtgtgacgttagttgttgatgataatcagatggtgattataaaggaagaaaaaatcgagtcatcatcgtcggagtattttccaaagatcgatgagagtttctgggcagatgaattatcgacggagaataatatgattattggtcatgatcaagaaatacaagtgagggaagaaaatgtagacatatttactactagttcaaaaatggaggaggacatggacttttggtacaatgttttcataaagacaggggatttgccagaattaccagaattttgaggggtctattttgattattatgtaaattttgagattaattagtggtatttctagctaatagttttttcttttttcttttaggaatttttggagttggcaagtttgaaatttcatgtttgtttaatcttgactattatttagagtggaccccaaaaaaataaaaaaataattccaagttgggaccattagctaggatattttaattttgaggttattttaaacttctcttttacttagtggagggctaattacagtaattagcaaaggaagatcacattttagagaagtactcttccgttgtcacagtcacttttcgtttttctagagtcaaacagtttaaatttgcatcgatatttacaaatgaaatcttcaaatcttttgaaatgaaatttatatttttataaactacatttaagatattataagacataataactgataatttaaaatatttaaaagatgaataaaaaatttataaccacaaataaaattatttaaatctcaaaatttaaaaaatattgcataaatttaaacggagagagtacttgtttaaaaactattagtactaaaaataaagtttttttatcaccgcaaatgggtgaaaaatttatgctataaactactaatataattctttcacttatttcttgtcaaaccaaactcattgacaaaagattaaataaattttcattgagatcatgaaaatttactatttttttcatataaaaatattattattattttctattcacatcgattcaagtaatatctgtaaaattatcattgagcattttcaattataaaattctgtagaaaagatggtgattttttgatagtaactcgtaaccatttctcctaacttagctttaactttttgtataaaaggtgtgttacatatggctttacatatatatatataataagaaaaggatgaaatgtttttcaccagttagtggtttaaagattttgtaatccattaggataacaaggacaataaaatacttttttttaatgatttgtcactttaaacaaattaaagaaggatgttgcaacatttccatcccctaaaccctttttctttttttctttttaaatatttttttttagaaaaataagtttcttataaataacaatttgtaataaaagaaaaaataagttttattaaaaacgttcta

SEQ ID NO: 448 - DNA, 14844 bp, Solanum lycopersicum
aaaagtggtaggtaaaaaaaatgacaagagtaaaaaacacacttaaacaattttttttaaaaatttcatacctaaactattgagagtgtatcatatataaactatcacttattagtttgagaaatatatttgtgtaatacactctcttttacttacaaaaatcttatcacttgacatttcacatgattgaaatattttaccttatcaaaaattaaacaaaccactgatattagttacgaactaaagaataaagtactactatttccaatttttttttttatgaaatagaatttaaaataaattaagagcgaaaagttagatggagacaaatgaaaaaaagtaaacataaattaggagcggaagattagatgggggtggggtgagaaaaatattttaaattttattttataaaaaaattaaattttcgggtataataatacgtgaatctttaatttttaattagtattagtttgtttaacttttgtttaggtgaaatattttattcatatgaaatgagaagtgataaaatctcgtaaataaaagataaaagtatactcccttcgtttcattttatgtgacacttttcgcattttgagatttaaacaagtgcatttttgaccgtaatttcctcatagatcattttaacattttgaactatcaattattgtgacttatagtactcttaacgtcgtttacaaatatataaatttatttcaaaaaattgaaaatttcatatgcaaatgtccaatcaaaattaaactgttagactctcaaaaaataaaaaatcgcacataaaatagaaaaaaatatattactataaaaatgtatttctcaaactaattaataataatttagatatcaactaaaaaaaagaaaagaaaagacatactgtactaatttatactatgtgatttggacaaaaaagaaaacaagtttaaagtgaaaggactgagttggacaaatccaaaaaaaaaaaccagtataaaacgtggtgagcatttccacaatcccaaactcatattagactagaaaagtgggtgaaggaagttgactgcacatttctgctcctacatttctcttcttccctagaaatggagacagttgattcaactcgagcatttgtgaagaacgtcaaacgactcattgtcaaggtctcaactttatcctccaatttcttttcctttttgcttttcagattggaaaaaaatcgtttaccctagaaggatttgatttttttattctcttgcacaaactaaatacattgactgtaatttcacgctgtttcaagccgtgtttaatgtatacaagtgacctgcttgttagtttttgaaaccaacaatgtgtatcctttgttttcccccctttttaggcttttcgctgacaaaattttatttttaaaggttgggactgcagttgtgactcgagctgatggaagattagcacttggaagattaggagccctctgtgagcaggtggatttttaaattttgttttgataggttaaaattctttgttggtatcaattgcattattctaaacattagtggatttgctgcatacagcttcaggagcttaattcgcaagggtatgaagttattttggtgacttctggtgctgtaggtgttggtcgtcagcggcttagatataggaagttgctcaacagcaggtttctactatgtccttgttgtcaaaaaagttatttacttgtagataggttacatttgcagttgatattaaactgtgcattagttaagttactaatttaacacattgtattagtgacggcagaagaaaaatattaaagtaatataaggaaagttggtttgatagaaaaacaccacattagtgtttaaactttgaatagtttaataaatttgagttcttgaaatttctatagagatattatagagtcagtcactttgggatctctaaatggaaagagtgtcatagaatttggatcttagatagtaattcatttcgtttttcatatctatgtaggttatgaagtactgaactatacaaatgcctctttgtaaataagacattaattgaagaagaatcaataagattacttcatgatttggtgtattactttttcttttttttttttgacaaaggtaacagtattttgatttggtgtattactgaaaaggggaataaactctatcttttatccttggtgacaagatccaatgataggatttgaattccagtacttgtaatttactactaacttgcaatttatcatatttgcagttttcttgatcttcaaaagccacaaactgagcttgatggcaaggcttgtgctgctgtgggccagaatggcctcatggctctgtatgattctttgttcagtcaggttgacacacagtttttggaacttttctgcttggtccaactcatgatatgcctatcataaccacaaaaatgtcttcagctgaaaatattgtctactgactttttattctttgtgtcatctttatacagttggatgtgacatcagctcagcttctggtgactgataatgactttagagatccagattttaggagacaactcaatgacacagtaaattcgttgctttctctaaaagttatacctatattcaatgagaatgatgctatcagtacgcggagagctccttatgaggtgtgtctctctgattttactatgtagttgctaccctcttgctccttgtgaagagttcctctattagtagatagatcaacaatgtttcttgctgtagagcctgatctgttgcttacatgtgtctagatcaatccatgtgttgggcgtagaaattccctaactagtgttcatccatatctttcaaatattaacttctgctttgttactaatgttcttgcatctcttttatatgttaacttcattatgctttgttataacttacaaagcataatgaaattatatgtatttatatatatgacatatagatgtatactatctgatttaggcttttacccatcagttctctgtaattattctcagtgttgattcctgggattgggaggggaatgaattgagatagtgcatgtggctatgtacgtcatttagcgttggttcctgccactttggcgctaaatttcatctttgctttgatgaggtttagtttgtagctgtaatatgatttcgagttcctgcaagttttctgtatccactattttaattaaaaatcattctttctgctcatagtttaattgtaatgatgaacattacttgtaggactcttctggaatattttgggataatgacagtctggcagctcttctagctttggaattaaaagctgatcttctagttctgttgagtgatgtagacggtctttacagtggtcctccccgtgatccagattcaaagttgatttacacatacattaaggaaatacatgagagagtgattacttttggagacaagtccagggtgggaagaggaggcatgactgccaaagtaaaagctgctatgtatgctgcttatgctggcattcctgttgtcataaccaggtatgatactagtatttattcaattctaaattttaatttttatgtacttcatttgtacacatgtttatttaaaatatttaagtgatgtcttcttaaacgagttgataaatttttttgatgcttcttgtctatgtgtttttccctttttcttgtcaataaaacaatgtaactgtccaaagagaagcatttagggtggtgtgcagcaaaagagtctgaatcaaagttgaatctagagttcagttgaggatgcacaagtaaatgtgaggtgtctgactggagctgaaagggaaaatgctgtcattgagtctgcatcgaagttgcatttatagcttacagtaggggagacagaagaatctgaggtattttactggagttgaaagtgaaaaacatgtcattgtactatgataaaacatgatattgatctgctgaaagcacaaataggcacacaagaaagaagaaaaagtaaaaaataagatgaaaaagaagcaaaagcaagaaagaacattaggtaaactgacttctgcattgcaaatcacgtgttgtgtagaatgcattttgagaagtattaaacatttttttcttgaaactgggaactttcagaagtatgaacagttaacaaatacttccctttttatctatgggatgtcaggttaaaacttagttcattaaatagaaagatgcatcatttcaatcaaaatggataacctaattgggagttggtatcaaatgtagtatccttagttcattaaatagaaaaatgagtgacatagaaatttctatataaaaggtatttgatttccttctattgcgccttagtttttgtattgattatagaaatctgtaaaactgttcagacttcctccattagttttggtcaaagtacccaaaatcgctagaccgaatcagacacggatcccacacccatgtcgtggcgacacgggtgcgacaccaaaagtgaagagtccgtgtaacttagggcataataaaagaattgggctaaaagagatttgagaaatatgtccttttgaagtcagtttgacttgggccaaagcccaaatttgttttgatatgcattgagtatccataaagatcctttgggttgagcttgttaattaatcagattttaaaaattgggccagacatggccatttttccattgagtcattgtcggattcatgatttggaggttttgagtgtcgcactgtttggaacatagacatgttgctatttacacaatccaaatagggtaaatatttgatgtgataactgttctggatgattttccatgctgtcagtagtatttagccatgactttttcatctccattatttctttaaccattcttcgttggactgtttttcccttgagctgcgggtctatcatgaacaatctctccaactccaaggtaggggtaaggtttgcttagactctatcctccccggaccccactttgtgagattacactaggcacattgttgttgggttcagtttgggttattcgacttttgatttatatagacaacttgaaaatgaaaaatgaaataattacaacttggtgtacaacaaaaaatttcaataatattactaatattacaaatatatataatttatttataaatgtactcgacaaagcatattttggaaacattctgtgatgcataactacttatattcgttaatatttcacgctttttgtgataaattaaacaatcatgtattagtttaggaggcatcttatttgtgtgcttacataagttgttaacaagtttaagcaagcatattgaatagacattacgtctgtgtgtacctccccaaggttaggtggtgtcacaaagaaattaatacatagtaataatcagttagtatgaaattggaatcaagatcggcttaggaagatgctccaataagtaatagttgaggctaaaatgtagtttttttttctttcaaaaagtatgaaaaagatttgtaaaaagtagttgtcggaataatcaagaaatgagagagttctgggaggatctgtcacaatttcaaacttcaatcaaatcctatatattttatgcctaataaaaagcaaaataaagaaatgaatcaatttaaaaggtcaataaataattaagtgtaaattttttacaattaagtcataattgccaaaaaaatcatctcacactaccttaatgatgtgaggtcattgtattttgtggtacatgtttataggtgaggtcgggtgttactgtaaaccaaaaaatgaaaaagagattggagaaaacaaggttttgtaatacacagacaaatacatactagagagatacaattttttgaaaatataatttacaaaaaataggatctacaacagaaaataggagagtgggaaaatttaaaagaaaggaaaaagatgagaggggtccatttaaatataggtgtcaaaggtgttatggttccatgggaataatcttttgcttaaacatggaatactattgaaaatgattaggaagtgtggtaaatgggaattgaactagatgtaaaacttaactttgccactggctcctctttaacatttctctgggtggcatgcctaataaagatatgattttttatacatatcaacataatttcaacctaggcctccggtggcatggcatccccacccttctacatagatatgcccctgcattgagtgcctagaaaacgtttttggcctaatcagcaccttaaaaatgttgcagtaaataaattgagcccaaattattttaaggccaaagtggccaaaattttagcaattggaacaaagggtttgtcttcaaatctggaatttggctccttaaaatctgtttgcatgaactctcatttttgtcagaaggcaaactgacaacttcgttaggaatagttgatttgttaaaagtctttaaggtttatctcatttgtgaacgcaaatgaattctggcaacatgctaaaaggaatttaatcgaaaccaaatgttataatcgaatttacgctaagttgcctgagcttctcaaagagattattctatatcatctttggtccttgtgaaattactgtgaaaatgtctattacggagcttagctagaaaggataactattcaatgaagagctttccaaggcgcgactcagttgatgaaactggattaaaaatcataggagaccacaatctgaaatctagcagaggccagctggacacagttaccttaccctatgtatgtattggtgggatgatgtaagtactcggttaaaaaatcacaaggtgcatgcaagatggtccaacacaccactgttatttaaaaagaaaaggtgtgttagcagaacaagatggtggcagtaaatggttaggttgaaaaggaatgcaataaattaaggctgaaaaacaaatgcgaatcactacaaatgtattatatgcagtgaagcattgttcttcagacattcagtatgaaagctcatttttcaatgtttcttgctcactttgcctaaacttgttactgattctctctctcactctgactgcacactttcatgggaataaagtggctttgcgacagataacatcatcaaagtgctgcatggggaacgtataggcacactctttcattgtgatgccaataaatgggcctcaattggagagactgatgctcgtgagatggcagtggctgcaagggcatgttccagacgtcttcaggtatattttgaggggcatctggctataacgttttgtaagctgcaatgatgtgactatgtattctttattcacctccaggcactgtcttcccaagaaaggagtaaaatattgcaggatatagctgatgcactggaagcaaatgaaaaggcaatcctcgctgagaatgaagctgatgtggttgctgctcaacaggccggatatgagaagtctttgatatctcgtctggctttaaatccaggaaaagtaagagcttgctcacttatgcaacttagtctgagtgatcatgtacctttttagtactcttgctgaaattacaactcctttgtcatagatttctagtcttgcaaactcagttcgtgtgctgtctaacatggatgagccccttggtcacactttaaaaagaacggaggtgagtgctaatatatgtggcacaataatttttattgacacgaggaacaaacagattgtgaaggaatcttttgaagtacctctttgtagaaaaccttctgaactatgagacgattttagtgggtattatactatcactatgtccagtgacaattacactgaacggtatagccaaatatatttttgtggttgtttagtttcttgagtcatggaatgaactggctgacttgctggaagattggaagaaatagagatgtggatttgtacttgcaactttcattgatctgtgttcaattataagcctttatttcctgaatggaatgttgatttgatctctggaatgttgtcatcttgttcagattgctgatggattcatcttggagaaatcatcatctccattaggcgttgtattgattatttttgagtcacgacctgatgcacttgtacaggtatgcggtgctggcaaagttgatgtttcccactaatagagactcagctgcatgccttttacttccccccttcccaatatgaattagtagggctcacttttagtagttattcaacacatttttgttactagcagtgaggataatgatggctgacatgtcactgtatgtaaacttatgcaattttctgcatgcttgaagtgcccatccttggattatacttttatcgttcacaaactcgtttcaattttttatgcatgactagatagcttctctagcagtccgaagtgggaacggcctcatgttgaaaggaggaaaggaggccaaaagatcaaacgccatcttacacaaggtttaactgatagttttatgttctcatacactctatactggaggttcacgttctctttgtttcatgacaactttttcaccttctcctcttttttttttgtgtgtgtgtgtgtgtgtgtgtgtgtgtgttgtcaggtgattacctcggcaattcctgtaagtgtaggtgaaagacttattggactagtgacttctagagaagagatccctgaattacttaaggtgactgccgaatatcttaggaaacttatattctatctctctttcgtttttaagaagtcatgacatacatcagacatgattttggttcttcgtttttttcctgcattgcagcttgacgatgtgattgatcttgttatcccaagaggtagcaataaacttgtttctcaaatcaaggcatcaacaaaaattcctgttctaggccatgctggtaattatgttacttgcatgataattacttatacttgctttctctgctttgatatcaagagttctgttccgataatgggaaagtcactttgtttgcttccagatggaatttgccatgtttatgttgacaagtctgctgacatggatatggctaagcgcattactgttgatgcaaaaatcgattatcctgcagcctgcaatgcgatggtagtttctttatacctttttgtaaagcagtgtccagtatttaacttcagtagtttatttcttttctgttttttgtgaatatttttcattgctttcccttataggaaacacttcttgtgcataaggatttggcacaaaatggaggtcttaatgatctgattgtggaacttcaaacaaaaggtttttttttgcgaactccttcaataattgagcttctacatgaatacctaagtttctgattttgggtgctggtgtccgaaatgagtggatctagagattggatccttcataatctactgtcaacagaaactgaacatgattattgcatctgtttattccttaatttcacaatcatagatgtaattaatagatctgggcgaacggatcctgtaatgtatacaggtacgcaggtttggctaaaaataattcaaatgtctaaattagatatgcctaaattatggtggactatttggaaggaaaggaatgcataaattttgagagcaagtttgaatttgtaattattattaagtacaaacacacttccttgctgtttttttttggtgttacatagttattgcaaatgatttagagttcatgatagacttcttgagttcattgcgcattcagcagtgatgttgacctataaatatcttcaaagcatcttctggtttttcatacaaatatcttttaacattaaaaggacatatgcctaattatgatttcaccccagcttttgttttgatttcagaaatcattgcatctctctcaaatttctttatcaattttagttataatacccaaaatcgattgaccaaatcccacatccacacacatgtcgtatcgatacggttgcagtaccaaaagagtccgcacaacttagatgaatacgttggggtcctgacttgggagtaggggagaaaaattgagatcactttcttaatctcagtttagcttttagttgaatcaccaacataaacactcttgttattaaatctcatctacaattaacaggatacacaatctatattgtgtttaaaaaagatatgttacatgttctgttccttgagtatttcattcaaatcttctgtatctcctttgttgtttcaaacttgatttatgatacataaaaagtaatcaaatattatgtaaagtccatctcagttgtcaaaatccatgagttacttcatacctgaatcctgattagcttatattttctgattgctccatggtcgcgtcacacttgtcatttcatcccttgtatgctctgacatgttatccatctttgtagttctcatctagtgtgaccctgtaccccctctttgtctttacatccaagcttgtacttaggatacccttaagctgtccatcttgtatgtgcaacctctgccatctcatgattgctgcgacacttatggttatccttattcatttattagcctatagattgctttatgatattatgggagttactaatgttactagtgtttctatttatagtttctaattatcaatgtgactttctggtcttgtgcactaccatcattgtggttagaagtggttaataatatttggattactcatgaacatgttcaagatgctttgtggatagctaatcaatgtaatactagctgcatacaaggcactaattgtgagctgtagttttaaagcataatctttttatattgagaagtgtactagccgtcaagtcaaggagaaagagcatgtggatgtaatatggcaaactaaaggaaaaatctgggtcctttctctcaaaaacatcaaaatgatctcgaaaaagatcacgtggagtcacacccaaacaacctggacaaaaaaagaagtgacttggacaagaagaaacgaagtagcttttttgttcataactcaaaccaatcaacttaatatcgattaatacatattagattgaacattactagaaaatggctctatcctaagttttaaaatatgtggtaaatgctgacgatctgcaacaattacttttaatgagaaaagtgatgctgactatcctcaacttgtttggccttgaaagaacagtttaattagattcaagacatgttatctgatgtttgcctctttgccaggggtttctttatatggtggacccaaagctagctccctgctcatgattccagaggcacgtacatttcgtcacgaatatagttcactagcttgcactgtggaagttgttgaagatgtatatgctgcgatagatcatatacatcagcatggaaggcatgttatgtttgcctatttttttactaggatgcattatgattatttttttaaaaactacttcatattgaagctccggttccatgcaaacttttgcaatccttattttgttatacccaactcactgcagtgcccacaccgatagcatcattactgaagatcaggaagttgctgaagtttttttacgtcaggttgacaggtatatttaccggattactttatcttatcattcttgtgtttttcaacttcatcctttaccacaactcatgaatagtttcttcagtctgacatacgaactacctgtttggattggcttttcgatttcgagttataagccaaaagccataaagttggaaattctaactttatgacttttgacttatttttaccattttagcttaaaatcaagtgcttataagcactttttgggtgtgtttggtatgaaaggaaaatgttttccatggaaaatgttttcctagaaaatgttttcctggaaaacaagcagattttggacttattttctcatgtttggttggtgagtagaaaatattttccggaaatgattttgtgtttgatttatgaatgaaaaatgttttttgagagacatcttttatttttactagagtagaaaataatttatgaaattgaaaaatattttttaaaaacaatttttatttggggtggtggtggagggggtaggagtgaaaaaataaaaaattgaactttatagtattttttaaaaacaaaattaatttttttgggggttgggggtaaatgggcgctggccggggggggggaggagtttaaaaataaaaaatttgaagttgaaaatatttttaaaaagcaaaattatattttttttttgggggggggggtggggagctggccggtggtgggtgggtgaagggtcaaggatcgggtaaaaaaaataagaattttatttgattttttttttaaaattgttgtttttcataaaaaaattaatttaaaattggaggagagttttggaaaatgttttcttaatttttgaagggaaatcatttttccttaattttgagggaaatgagttcatttgcaaaacatttttcaaaacttttgccccaaacaaacatgagaaaatcggaaaacattttctggaaaatgttttccttcttaccgaacacactctttatatttttacccaaacacttcaaaagtgcttaaaggcacttacaataagccaatccaaacaggctgtaagtcctctggcatttcattagttcccaataataagttttgctcattgtagtaatatacatttgtttttcactttccagtgctgctgtatttcacaacgcaagtacaagatttagtgatggattccgctttggacttggtgcagaggtatataatctatcagtgattccaaattatcttttggcattgtagtttcatatttatctgtgtctttcttggttttgggtgaataggtgggcattagtactggtcgtattcatgctcgtggcccagttggagttgaaggattgctaacaactaaatggtatgtgtgctatgaactgtctttttacttcagttcctcatctacttctttctggctttaagtcctacctggaaagctaccactcttgagagttcgccttttgaaacaacaaaactgtttcttctcaattctctttggtgactcgtatatctcttatgataaaagagaaaatggaagtaaagaagatgatatcagtttaatctttccttacgcaggtcgaaatgaattctctcaacttgacctagatacgatttctttcctatacgacatgtccttgagctttattacatttgctacacctttgtcatctctaccattagtttagggtttaagaccaaaaaatgtctaatttttgtttagtgaaatacatctaaggaccataataagtccaacccgtatatattaagggccattttatcaatacttcatcaccaaaatgaaatgaaaacaataaaaaagatcagaggcatgagtttgccatggttttactgtgtttatttgctgtttaaaatctataccaagttctagagtccagtacctatttgatgctttttcagccgtttcttacaattataaatgggttttcttccttaagcttgttttacttattttgattgggattgaatttcattgtgcattttggacatgagttatttacccaatgctgcaattttgtataggcttgcaaggggaagtggacaaattgttgatggtgataaatcaattgtgtatagtcacaaagaccttactcagcaagggtgattatccagttgtgtatttaggaagattttgtatggtgctattggtaggtgggtttggggcttacccaaagattttctgtattttccagccattgacttgtgatcatttgcagtcttcacattattctgtattaacatagttatgttgttgcataggttttaacttgcaggactaacttgtcccaattataataatatcgaaatatgtattccaaataattaaaaaaacgtttcatatacataaatgtcctgcccagcttgcaatttttcttctaggttattaggtaattttgccaaccaaatcttaggtagacatagatgaggccttctctatagtgagatatcaacctcgttttcacaatttgtactagatttatttaatattaaatccactattaacaggctgaggaattcaatattaagtcaaggaaatcaattaacttaaatcttgcattaggagaaaatcaaggtttaatttagaattaaaatgctatcagtttattactcagggaaacaatcaagagaatctagaaggtaatttaatgaacattgaaaaatgagatacagtacaaggtagaaatagaaagagaaaatatataaacttgacattaacatctattttagcactttaaccatgcatagatttatttaccctcctaatcttgtataataagtgtattctgttaaggtaaaatgcttgagtaaattttacggtgacggatttgaaatattttctcaaacaaaaataacacatacatgaactatcttactgaaatagttcaagagagattcattatggtgaaaaagaataaacctataaattacaagtgcgttcaacttttatcttttaaaaggtagttgatgaattaaaaattctaaagagatggggctagtttcaaatatatacaataaagtagttagtttacggtaaatatagtcataaaaaatatacattgactatacaatataacttatatatgaactctacactttcgatacattataatacacacaaaaattggaatatagcttaactatatatgaagtatacgctgacttttcaatctcgatcaactcaaaatcatctctaaacattcactagctttagatataaaattctctcaatgtttcgagtctttttgaggtgtaattcacttaaaacaattcacatttgcaatatctcatttttttaaaaaaagaagggagacgaagaagatacagaagaagaatgacaaagaa

SEQ ID NO: 449 - DNA, 4806 bp, Solanum lycopersicum; identical to SEQ ID NO: 359

SEQ ID NO: 450 - DNA, 13103 bp, Solanum lycopersicum
  modified_base (8250)..(8933): a, c, t, g, unknown or other
taattaaataaagacatatgacatatatgtcaaaaataatttttaactaatgaattttgtattttaaaaaaaaaggcaatcacgcaattaacatttgccatttttaaagcctaaacaatttaaaaaaagtcgtacatccccccaagcccaccccaccccacccctgatttccaacccctttcccaccacctgatcaccaaccccttccccccatccaaaccatcttccccatcagccacaccacccgaactcctcctctcctccatccaaatcgttttctcgataaaatccttttttcaagtttatgattagttctttatttactatgcaaaactcgcttatttaattgtttaattgtttttctctattatttctatgttttttcataaatcaaaacaattattgtttgatttactataatgctgattgtttttgttttaactaattaacattatcaaatctatttttcatgaaagaagtttaaattttgggagataatgcttaaaaagtttgggaaaaggacaaaaaaagtagaataaaaaatgattaaataagcttttcatgcgctggtagtgaatgtatctcacttattatgtcatgtcagtaaaaaatatcaaattaacacaacaaggcctgacatgagatgtgtctagaatgaacaaaatataattaaagtatctaagtgaaaatttgtattaagtttaaattgtcattgatgaattaatcttgaataaaagaaagacattttgaatgatttctaatacgttaagaatatttgtacaaaaaatttaaaatacttttgatacaactgatcaaactttcgataaaaattaatatcattataattaatccaaaaatatctttgtcatctcactaactaccactattacagaacgtagagtagtttgtggtagtaatcatgaaaatgaaaataaaatcattttattttctcaagacagctaattttctacttctattgtttttttttacaaaaagaaataaggaaatgacaacactcaaaaagtgtaaagcaattttaggcatatataccaacctacatattccccctcgtgcctttagcttaattacaactctaccccgagaataatctatttttctgctcactgttctcaatatatctcgtaatttcaccaatcttcaagggcattttcagcacgtcctccctcttccaccacctcgccaccttcttcctccaaattctccattaacacacatcaatacgttgacgttttgatatttgaacgatgccggagatagaaaggcatagaacaaggcataaccgaccggcgattcgagaaccggtgaaaccgagagtaccactgagactattgttacgagtagcttcggttgccggtggaattcaattcggttgggcgttacaactatcgctgctcacaccttatgtgcaggagcttggaataccgcatgcttgggcgagcataatatggctctgtggaccgctttcaggtttattggttcagcctttagtaggtcacatgagtgacaagtgcacaagtcggttcggtcgtcggcgtccgtttattgtcgccggagcagcatctatcatgattgcggtgttgattatcggtttctccgctgatattggatggcttttaggtgatcgaggtgaaataaaagtgcgtgctatagcggcgtttgttgtagggttttggcttctcgatgttgctaataatatgactcaaggaccttgcagagctctgcttgctgatcttacacgtaagcttttcaattcaattttacagcttgattttcattttttcccgatttgtttattgcttgtgaattactctgcttctgctgcttcttttttacgctgttcaatagcttaaattgaattaaccaatccactgagctattaagatttaaccaatccactgagctataaagatttcgcttcacctgtaacttatcatttgatgaatttaattgtttagtgctttttgaggaagatgaagcttcaaacatcttcgtcaattatctaatggaatgtttagctttcttcagcactactccataagaaatggaaatgcaatagatgtgttgttctactttttttgtgacggtaaaaaacgtatgaggcgcactagttcagctcaagtagacagaaatatcccggcaccgatagtgcagtgggaccccctctgtatcctaaaattctctcattctctctcttctcttttttactccttttaattaaatattagtggctgatgtacacctaactgagttgagccattacgatcatgggggagcatcgttagactatgttttacattgttattaaaaaattcttattttttaaaagcattttcttaaaatagcttttcgtaattgaacaataataataatttgtgtttagttaatttatttgaaaattgcttttgataagcacattgtgtgtaagtaatttttttttttaaaaaaaagtaattttgagaatcaaattatgaaaaaaggacaaatattaatgaacttttaatattaagattatttatagagagacattattttaaatatcttttataaatttttttaaaatttttattataaaatgtatatattcaaattttcaatcaatatgacacaaataaaaaagataaattttgataatattaatatgatgtatttataattaaaataaaaatatcaagcaaaataaattttaaattatttcacaaattaaatccaccaaaaaataaatactctttgtctctaatgacttgtctacatttccttttttagttgcccctaattatttattcattttgacaaagaaagcacaatttttttctcccctcaatttattactttgaaaaatgtagcacttcttgaaaattgtaagtttttaaatcatccatttcataattaatagagataaaaacctaaactcacgatatcaattattgttttcttaataggttagtcaagtcaaaagtggataagtgattagaaatatagcactaaatataagggatatattgataaatatttttatatggtagggatatgttgatcttaaaaaatataattttctgcttctctttgcttttttgatggactaagctatattatccgccaaattatattgactaagcttattttatctgccaagagtggatttgaaattttactgagcaggatcaaacagttttgagaagttctctcttatggagtatttatgtaattgttatagtgatcactttgacaattcattgtacagttggaatagagtactacgtcttggaaatttaacatacatagaagctaaaaagaatacaagttacaaatctactaattcaaaatgactagataatcatttaaaaagtttagcacacttttcatccttgatatgtgaagtaggactgctagttccagtaaaacacttatatttgaattgtggtttctgttgccataacctttacttatggtgcatgactaaagataattcaaaaatgcgtaacaatttttcaagttcttataactctttcttcatgaatcatttgtacatacatgtcaataaggttttagataactcttcagatttgcacaaaatggtgcaaaatttgaagccacttagcatattgtgataaatcattgcacatcttaacaggggtaaaagtcaagtaaataaaggttaaatgccactgtttatttaatcatgcctgggaaggtcactaccactgtctccactcaacatcaattgatttttgcttccattgctgatacacaattgcatgtgaaattagataactgtagacgaggtaaatgctaaggccgtagaagtcatacatatgatacttaaagaaggaagaagtagggaacaattcattttggagaactagtatttgataaagcagttgtctgccccttgtgcagttgcactgggcttcattcttgtggtgtaaagttttgataaaaaatggatttttgtgtatttttcgtatagacaatcgaaaacttttcattgacaaaaaattattgtccattccactgctgaaagtagcagaaacattacggttggaaaagagcgctgatgttaattgggaataaatcattcctattaatttacagttggtagttcaaacaattaaaggtgaaaagatcatatgccactattacttattatggtcacactattgtttcttctttgatcagatttctcaaaatcatattattttaataaaacatagatcatgtatctcagtgaatctatatgagtttcccctttttgctttagtccttttcactattggttcgaactagtatagcgcagtgagaggaaggctcaatggtgcaatgtttggcactaactatatcatagtccttgacattatccacttaacatgtctagcctgaacatgccaaggagatatggctttttattccatcctttgacttgattattaattcttgacagagtaagaacaaactcatcatgtctggtcaatttcctatcaaaagctaaaagcctgctctataaaacggtaggtcctgaatccacaacatttgcaatggtgagttaaacaagtaagaatcatcttttactatgtatccatctgtgagctgtttcttttgataaggtattatccaagcaagtacccaggaggtactgcaaaaaggaaaaggacagaattacacaagtcttgagaagacaacaatcattcatctcaaagaggttaccaaatttagcacaactaaagttcatcaatttcctttcgttaaagcagtagattatgcatttgtacttaacagctgcaatctgcttcccctctccatcaaaacattttctgtttctttccaaccagatactccgcacactgtacagaggggatgtcctccatattttctcagtccagatttctgcacttgccagattaatacaaaactattcagatctcgtggcatgacccaatgcactacaaacacacataacaaaactgtccaaatctgccaagaaaatttacaggaataaacaaatggttagttgataccacttccctttgacgcagccaagcatttctagtttccacccacctaaagaaaacaattttagatggtgcttttgtcttccaaatcatccatctctgaactgtttatatgagacaaacaaaagctagtttaagtcttggtatcacataatttgaagcattgggggttctggaattttactttaagttcaagtgcttgagtgagtgatggactacagaggtgatttcgagaggggagagagataacaaggggtaatgggagatgtgtgcttgtggcggtgtggattttgggcaaacattattcttggagcatgaaatatcatcatcaccttcttttctctctgagattagattttgagctaatttccctagagatattcaaaatctagctcttacaggagcctttaccaacagcagtgaaacaaaatcagaattcactagttttctttatcccctcgtgcaggatagaataggaagcatttgcttgttactgagaagattgtggagtcttatatctcaaaaagaaatgattatggagtctaatgattaggtctactttgtctacatacactgtgtgctccttgttcctttttactctaagttttaattagttgttaataatattatataccctatctaaagagctagtaagacctcctaaatttgcgtaatatcctcactttgttgaagctaactcacgtatccaaaattcaaaagaaaatcttattttgtcgattttgacctctagtttcagccatttaggagaaagtaatactgaagttcattttatggattttaacccccagtctcaactatttaggagaaaataacacttaagcataagaaaagacataatggtgaaaatggaggctacggtctgtcgatgcttatggggtttgaagaagaggacctccatgggatgatgaatctatggtcctattccagagatgatacagccaccaaaagaaaaggctttgtagagcttaatttttcagggcgagatatatcagttatacatttttgtaggacttcattgtcatttatttgtgcatatttatatcatgaatttgccgtcaaactagtgacacttcctctgctctctaatatgcagaaaaggatcacagaagaactcgggtagcaaatgcatatttttccttatttatggccattggtaacatccttggctttgctactggatcttacagtggctggtacaagatcttcccttttactctcaatactgcatgcaccatcaactgtgccaatctaaaggctgcttttattctcgacattatttttattgcaacaacaacatgcattagcatatcggcggccaatgagcagcctctagatcccagtcgtggttcctctcatactggagaagagattgacgaatcaagccatggtcaagaagaagcttttctctgggagttgtttggtattttcaagtatttcccaggtgttgtttgggtgatcctgcttgtcactgccctgacatggattggatggtttccatttcttttgttcgatactgactggtttggtcgagaaatttatggcggtgaaccaaatgacggaaagaattatagtgcaggagtgcggatgggttcattgggtctaatgttgaattctgtccttcttggactaacttcattgttcatggagaagctctgtcgaaaatggggggctggtttcacatggggagtttctaacgtggtcatgtctctctgctttatagccatgcttataattactgctgttaggagtaacatagacattggccagggtcttccgccggatggaattgtgattgctgcgctggttgtattttctattcttgggatcccactagctgtaagttgctttattttgaagtcacagccagaagttattttgcactattacacaggtttatgtgtagaactaattaatttaaagcacctctaaaccacttatattcttaatcttcaaaaaattttaacagcaggggtggtatatgtgctgagttttggtttgcagagtttgttactgttgaaatgtaacatagaaattcggtctatctgaaataatcttttcatgtaagatgcctggaaaaggcaacacgatacaaaaagaaatttgaggttactgtttcaaaaggatttagttttagcacaagtttcatggtggcttagaagagagctttatttatgtatattattgtataatgcaagtcattttctgcagataacgtacagtgttccatatgctttagtatcctcaaggattgaagctcttgggcttggacaaggtagattgagttttgtctattttgatcaatattctgtaggtcaaatagaaaatagagcatcaattacaacttcaaccttgcaggcttgtcaatgggcgtgctgaacctggcaattgtgttcccacaggtataaattttgctctgtttctatgggttttcaccaaaacaagaacactctctagagagtggttccaaaagaaaataaaaaaaatcatagcctttatgtagattgatgtgccacaggtgcattgtgttgcctcttgccagtttgctcttgtatctgttatctgttgagcccttggttagagctgaaaaaaaatgaggcaaggagtggaggttataaatgataaaatctagagtactttcaagcgaatacagaacattattattctaatgggtgtttccacaaggaattttagctgcacctttgcagcatgtgtcttatcatttcctgaagttatataggccactgaatgaaaaatattgtcattggttgcagattgtggtttcactgggaagtgggccatgggatgagctatttggtggaggcaattcaccagcctttgttgtggctgcgctttcagcatttgctggtggacttatagccatcttggcaattcctcgaacacgggttgagagacccaagatctttgcatgaggtaagctgctaatgtctccgtttgtactcctttctattctctgcttgtccaccacatttaaattatctatctccagttttctgaagagcaggctgttgaaccaacttttcccacttaaggacctttaatagggctcaaattttcgctaagagtatccaaaatataaaaaagtgaacacacaaagaagctaatgggattcaatatttactatatatatatatatatatatatatatatatatatatatatatatacacacacacacacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatatatatatatatatatatatatatacacacacacacacacacatataaataaattatttgaccttgtatatattgtacatttattggcgctccctcaactccaccccttccctcagtcttgtatatcatctctacattcattgtcttgaactcagacgtcttcttttattccaacgttttagtaacaaatctctggaagcttagcaaatgaacagagtggaggcaattcactcgtaatttgtccgtatcggcacttagaatgacgttttaagattctgttagtatatcagtaatcctagtaattatactttagattagtagaagttactaaaaaaatgaggaagcatttttccctcttattatgtatgttctcctatttgaatacatctgcaaaaactatttaatccccataacttgaggacatgaaactaaagaagtattgaaaaacacgtccgagagaacattttgctttcacagacataaactgcataactggtgtcaataatgtatttctaactgtggaatagggcaataatttcttgttaacttgactaagtaacaacaatgtatgtattagaggtcgtcctttatataatagttctagactacgtacagtatgggaagtattcaaacctctatactactaacataatttaatctataagatttttctgatttaagtacggcaaatctagatatgtatgcttataaatacaattttctttatattccaacgctaatttaacacataactacaacagattaggaatatccatactggctaacaccatggttataaatttttttgtatttgatcctcaaatatattttgtaagaatatcaagtaactagtcactaaaattaagcaaaactagtcaaaacacatatttttattgataaccgttcctgaaggctaatgatgcacagttcaaaactcggtggatagtgggcttacccctctaccctagtcacaatacatttggattccatcttttatcttataaaaagacaaatccttttagtatattgattcttggtaacatgagtttttaagctacatgcagcatcacttgattttcaaatcagttgcatttttcaatttcttcaacatatcaactctaatcgaactagctttaaccatataagccacatatgactaaattacatggttcgatactgtcttctgcgtttaatctggtcaccacatcttattattctagtgtttcaaaatattatattacccgttaaaatgcaatgctttgaggcagacggtctggtggaaggagatcatatccagtttcaatgaaataatccataacctgtgtgggatgcaactgaaacgtctgatcatatcactgttagataattgaacaacatattaaacatcgatattgaccttgaaccttttagagtctcctttttaaaatcagccttaacatttagtttcgaattaactatcaaaatatacatcctatttattagtgatgatttttagcatcttttagcgtctagtaatactccctagaagctatatctattaaactagttaaggtcaatgtattaatccgcctactcaattctagttgggctccttccatttgactaattaatttgttttttcaggacaaattaggagttttgggtttctctaaatgttacacctagcctacactgtcatttaacctctaaccaaatttatcacacagttaagattaatgtatcagtcctccttcgcaattctatttgggccacttccatttgactaaataatttaattttcaggacaaatttggagttctccaaaacttaggtttctctaaatgttacacctaggctacactgtcatataacctctaaccaaatatatcaaacactgcacgtaatgtaagtgtccatatgactaaaccttaattcgtgtaacaagttggtatcacttacacaagtgctttgcttccattagggtagaaggtaggaggtagtagagcattggttggtttcccttaccagtatttttattattactcccatattttcttattcttcaattttattatcagatgttgtttcctttgtttcggtcatcgtattttttgttgttgctactgttctcttctccgttatgctagcatgactactttacaactgtatttcctgatacttgattttattttgtgtctttcgagccaatgttctattgtaaaccacctctctactttcacaaaggtaggggtaaggctgtgaatataccaccctccccataccccatttgtggatactggtattacattggcatatgtttttgtaattgttggtagatgtacatggcacgaattgtttcaggaatcaagctttagattatggtgaaagcatattattcctgttattgttcatttttcctagatgcattcaaggtgtggtctggatgtcaatgaagtttaaagcaccattgaacactgaagagtgcactacaattatcatctcatatttagaatccttttcgaaccaagtcattgaagaaatgcactgtacatttttgcataaaaatcgaaatttttcctcatttacatgcaatgcacatgcttaccaacttgcaacctttaagaggcttttaatcattgaaaagaatttaccaagttagggagtattgattaagctctttctaaaatccactgtttctagccaacttattgaagaaataccttggaagtgtttttgcataaaaaatgacaattttttcctcatttattcccatatgcattcttacaaaaattacttatcttctgcttattgacaattgtggtcactctgtagggatttcctgagtctattttttctattggactattgcctactttttcttgagctgctgggtcatattatttttgttctctgggcaggctattttgtcatattggaagatgaaattgatggtggtggtaattctccacattggccctggcaggacttgatttttctgttgtggccgttttgagtattgctcaatctgaatgctgaagaattcgcggaggtatactgttgtattctattttttttaaaaattttatgatcaacccgcattttgcattatctttttgtaaatatagctcttccacgctctgggtattgatcctagtgttcaagatggctttctgtgttcatcatttatttacgtagttactcaaatttagccactgaacaattttctatgtggtgtttctcttctttcttgataaagcatatctcaaatatcactacaaactgtacaagtagtgttcagtatataaagcacatattctttgtgcatttaatcttatctctgagtatagttttactctgtaaatagtactctttttcagctgcaaaggcatttatcacatccttatcgcagaaggttgtatatagtactttgtaattgtgctctgttagataaggctataatcatatcatcattgctgccagccatttatagattgttagctttgacatgcaataaaaactataatcaacacagtatagtaacaatgaatgtctcaagcatacgtaatggcaccctaaacttgtgattccgtggactgacatcacccacagggaaatagaaccaatttgtgatatataaaataacctggcttttagatgcccgttatctatgaagatggaggatacatacatgaaaaccaatctggatcattatcagggccatctttttctgtagctcaaaaccaaatctcttgcaccaactttatttcctatgtacgtcaaaagtggtgtagttgaactcaaaatcattaactcgtaagattacagagaaaactatctcagcacccagtcgcatgctcaaagattttcaggatgtacagaatgttccctgcacgagcaatgactgaataggcaatttgacagcatacatataaaacctcgggtccaacttatgtgcaattagttccttaatgaaactttttcatttgagctgccgatagcatggtgcaaaaagattatccactaactctgatgagaacgagtttcgtgtcagatgtttcatcttattctgctgtaaacacagcaggacacaagtttgcatatctttaatgtctgatagtctatttgcgatcttttgtcaaccattcatggtcatagagtctgtgcc

SEQ ID NO: 451 - DNA, 3940 bp, Solanum lycopersicum
gataaaacgtgcttcatatcaaattatatcgcatattaatcattaacgtatctcatatgtttgttacgtctcatttaaacaaattattttattatttttctataataattttatatattattagtttatatttatatgtttttcatgtattcttttggagattaaaaaaacaataatacttttacaagattagaaaaaataaagtcccccgtttaataataattattcgtgccctatactatttttgaatgtccaacaacacttgtccactttatggaataaataggcaattttatatataatttatggttacttttagagcaactttcacatatagcgaacacaaatcatatttgtatattataactatggtttgcataagctccatagcaaacataaatatgtatatttagctataactattccaaatgatttaaaatataattagacactagctataactatatcaaatgattagtactctaccaatttcacactagaccgttttactagtttttactgtttactcacaacccaaaaattgaagtaagggattctcaattatagctattgattttaattttagtttgtaatcatagattgtaatatttgtaacttggtaaagattcgtaatttgattaaacataaaaaaaattcatactatattttaatggtaacagtaattatatgcttttgtactatattttctcttattgatgaaatttgtcattatctttcttgtttcactctatcaaaatattttgagaagtgaaaaggcatataatattttggagatatttttttattaaataaatctaaaatcaaatatataataatcaaaaactaataaaaaatatcttattaaattatattaatttaacatatttaaaaattaaaaattaatgaactaaattaataatacacaaattaaatcgaatcaatctatgcacacaccacggagaagctaggataaagatgcggagaagaatgttcgagatttgacacaagcgtggcaagctttgtcatgtggaaatgacacttttcttgttttggcatgcatatctgccacgtcaaagtttttagttctatatgaaattctcatcccaaaacacaacaaaattaaattagaacagctcgaaaataattgaaggagaaagcaatatttatatttataaaaaaaaataaaaataaagagtagagaattagtgatcaaacgcacgcggcaagagagaatacatggaggcggagacaagtgcagctagtgatactcctgttactaggaagaagatgataatggtggctatcgatgagagtgaagagagtttctattctttgaaatgggcattagataatttgatcaatgatccttctattatcatcactctcatcaatgtccaaattccttttacacccatggtttatcctgctggacctggtatgtatgtatttctacttattggatcagatcttttatctaaaaagataaaaaattgtatgcaatgaaactaaaatatttaatttgggagggagggtgaagtaattgtttttttttatatatttatagttgtctttgcaacacctactgttgttgaagctgtgagaaaaggacaacaggagaatgcaactagaatactctctcgggcactccatctctgccaacaaaagatggtatcacaatatatttctggttgcttatatatatatatttttgtgctaattttatgattgggtttaggtgaaggcggagactctgattgtagaaggggacccaaaagatatgatatgtcaaactgcacatgaattgcacgttgaccttctagtaatcggtagccgaggacttggcaagattaaaaggttcattttcttttcgcccaacacattcattacattattggaataggattatcccatgtaaatatagaataagctcaattctttatatttataaagtagccatatttaatttgtatgtcttagtgatatatatcaaagtattttcaccaataaatcagggttgtgcgacaagttgaatctcgggaggaaatatgtgggcataattaaagagataatagtccaatctatgaaatatgttttaaagcttccacaattctctctctgcatacaaaacatatatacacattacttgtgcgagaatatcatctgcaaaggtaaggtgggtaatcttatgataagactgaagagaacaatctggccttgagcttttattttacattcatacttaataaaaaaagagcttaggtccctgagtcaaatatgaacacccctgttcctcgatggactttcgttgcttcatctccatattcttttacacatgaaatttctaaaatctgacatgttaaagttttcactaaattaacagagaatctaaattataattgaggcatataccagtgatgagacgtccttacttgtagattgtatgtgcaacatatgaagttaattgctcttgttagattgtttttgtatgtaatattaaggttgttttgcagggctttcttgggtagtgtgagcgactattgtgctcatcatgtgcaatgtcctattctcattgtgaagccacccaaggaaaaccccaaaagcagctaattaacaaggatatatcatgtgccagtctatgaacaatgtcatttacttgatgatgaataaacacaagttcattgaggattataaaacttatgtatatattaattatattatcaataaatggaggttgtatctgttgtctcaatagctagcccagtccacaggcaataggtttttgggtaaaagccagtcgtcacaactagtgcaatctgaatatttgaccctcattcctctggtaacgcaagttgctgcagcttatgtggctctgtatttggttttaataaatataacaattcaaattagagatatctagcacttcaacctcgatggaacaaatggaaagggcagttcttggtctttttaatcacgtctttacctctctttttgtgtgcctcttctcctcgatttcagctagtaccgtagtccattactacgagaatgttggtgataaagcagaacaatatatatctgctttgttgatatttttcatgaaactcccatcggtgttaattttgatcacacttgcatatggtctcattatctactttacttgccttcattttatttatgtttcaagcttgcaatagtctcacatatattatcagaagattgttgtgccattgaattcccttgccaagaatagtgtagcctgatattccattctttggttagactcatgtatgtttagattagttctatattagcttaagaatgaccaataatgcatcccggttgactgttgttaatatgatgataataataatatgataaatctaaatttatcagatttcttccaaatataatgtaataccccaagagggccgacttcagaagttgaaggtaccaacccacgctggccacctacagccagtggatgggaatacaaatcgtaggtgaatctgtggttgaccactagcactttccagaaggggtcacaacggtcgggtccggtcggtgggaccactcttcgtggttgaggcccgtggtacaaattgagtttctgaccatgaatgacagtccgtaatcagtggctgtcggtgggcagctgatagtactttttgggcatttgggtctgtttccaatcaattaactcctgcactgcaacatcttgcctttcatcaaggattatgactcccaaatttttcagtatctttcagttaatcaaaatgaactctctcaaatatttctctatttaaaacttgaagaagacgaataattcaacttagggtttcaactgagcctcaattactccattgaagattagtatttggtccaatgaacccatccaatctccatgttttcaagttatgattatattaatatagaattttgaatc

SEQ ID NO: 452 - DNA, 4236 bp, Solanum lycopersicum
gaaaacttaataattaaggattttaaaatatatggtaaaagataggcaaagtatccattatccccttttaacttgaagtctactaggcgcatgtgaaagttgattttttgtcacgtcatatagctataacgtaaaaaaagaaagtaaaatttttaattttttttaatatatgacatattttaaacgaaatataggacaaaatgtaaatgaatagtaaaggaaacaaagattaatacttactttgtaagaatttaagataaatttaaaatttaatagatcaactttacgtctagaaagacccatatctagaaggaatttcacgaaatcggcccttattcaaaaataacttttaaataatgaattttaaattttaagaaataatatccaatgaataaatgacatgtagcattttacctaaatatttcaactattttaatccaatattaatttgttttattcccaacaatagaaagtcttgtgcagacatttaatctgacttttccagtactaaatattaattttctgaagattttcgggtttagtccacaagttttagtgagaagttttgctcaaaattttaggtgagaaggtttgatatttatcttttgttaaattaatttatctaggtgactattatttatttaagtagaaattcatatcattacttttgccaacttgtagtcataataggagtaggtgtatatgatgaaggaataaacaagttcagtgaagtgattaaaataaaatataatttaggtgtacatcaaataaaaaccttaaagtttagaaaggcaccgaataattttgcatagaagatattagtaaatttataaaaataaaagaaatgtagttgtcaagttgtcttcttttttttggataaaaatagcagttggcttatgtcattcttttacaacctccatgccacttgtccaattgttgacacttaactaattagtttgattcatgtatgaatactaaataattttttaggactgactcaaatatttttatattatcatagtaatatttatctaatttttaggaccacttattactaaataataaattaactactactatattattgttgtgaaacaacaacgttttggttgttatgatgaaacgtacactatatcagtatgaaaaattcaaaacgattagtataaattatattgaaaatttgatatttttctattcttaatcagacgtattgggtttcatattttaaaaagggactaaacttagaagagaagtttgtttgaaactacttttgtctctttcttgttcccatttctctcttagatttcaaaaagtgaactactttatctctttctttgttcacattttattttattctattataaatatggcatcctcatattgagatttttagaaattattctaatcattcacagtgcaaaagaagatggaaagccctagagttgaggagagttatgacaaaatgagtgaattaaaagcgtttgatgatactaaggccggtgttaaaggacttgttgattctggaattactaaagtacctcaaatattcgttctaccgccaaaagacagggctaaaaaatgtgaaacacatttcgtttttccagtgatagaccttcaaggtatcgatgaggatccgattaagcataaggagatagtggacaaagttcgagatgcatcggagaaatggggttttttccaagtggttaatcatgggattccaacatccgtcttggacagaacgttgcaaggaacacgacagttctttgagcaagataacgaggttaagaaacagtattacactcgagatactgcgaaaaaagtggtttatactagcaatcttgatttgtataaatcttctgttccagctgcaagttggagagacacgattttctgttacatggctccgaatcctcccagtctacaagaatttccaactccatgcgggtaagtattttcatttcttagtctggagattctttagtagctcagtggcagaggcggaccctccgccgggtgctcgagcacccattaatttcgttacggaatatatatatatctacgtagaaattaatatgtatttgtataaaattaacatagagcacccaatgaataaacgatttagttggcccaatggctcctggatgaatactctgttaacacatattttttatattttcagtttaaatttctagatccgccactgctcagttgattgactatctaaagacagcaaaaattcctagatctgtcgctgctcagttgattgagtatctaaatacagcaaattcttagatccgccattgcttagttgattgactatctaaagacgtctgattttatataaaaatatgtcatgtttcaatgcagggagtcattaatagacttctccaaggatgtgaagaaactgggattcactttacttgaattattgtctgaaggtctcggtctcgatcgtagttatctcaaagattatatggattgttttcatcttttctgttcttgcaactactacccaccatgtcctcagccagaactcaccatgggcaccattcaacataccgatattggttttgtaacgatccttctacaagatgatatgggagggctccaagttcttcaccagaatcattgggttgatgttcctcctacacccggttctctagtggtgaatattggagattttctgcaggttagtagtcgatattatatacaaagtttatcgcgcaacacatttagaaaatcttttttttaattattttttgcagctcttgtcaaatgacaagtacttaagtgtcgagcacagagcaatctcaaacaatgttggatcaagaatgtcaatcacgtgcttcttcggtgaaagtccatatcaatcttccaagctttatggaccgataactgaattgttatcagaagataatcctccaaaatatcgcgcaaccacagtgaaagaccacactagttacctccataacagaggcctagatggaacttctgcattgtcccgttacaagatctaagaataagaataataatgttatctattattactatttatacttctgcagattgtacctttgaatttgaagcaaatgtttgagttaaatactttcacgtttctaagcaatgtaatataatttataaagtatgtgcttgctatatattgttgtttaaaacattaaataatattacataaatataaacaccataatataaggatgtttagcattgtgggaaaatgaaggattaataagtcatattagtatttctctatgtcacataaatgtgccttcaactcaatttccgctgatatttatcttcttttattttaagtagacgcttaaactattgtataaaattgaatgagtagacatactcgtcctatattacagttctcgtgaaataaactcgattctcgaaatgatttgtgttatgttatgcgggatgcatattatgttgtaacactcgcaactagaaagaaatagaaaaaagtttaaaatccaaaaataattacttttgggaagtataaggaaatttggaaaattttatgttaaaagtgagtttttggtcaacttaaaacgaccataactcctagctcatgatgagtaggtgtagttccatatatgattgaaaatctcttgaaatgatctttcgaacactgtcaagtttgcataattccgaattcgtattaacgagttatgtcttttggaagtttgggtgttttatcaaggaagtccaatcaaaatttgggaagggaaaatttgttttttccttatctaatttagggaataattggggctaaagaagacttctttcagtttagaaagatttagaattcatgctagggcttggtgaagagaggaaagaaaagaaaagaggagaaatcaagaaaattcagagaacatttaatcttttcctgtgaaatttgtcgggagtgattcctaaaaaggtatgtgagatcacatggcattgggttagttcaaccacgcaccaaccatgtttcaattaggcgaatttgagttttgaatgttaagatattgagttcttaaagaacattgttgaaagtttcattgagttcttgatggttgtgttgttgaagtttcttgatggtttgaatcatgttttctggtgtaatttcgggttgaatatattgtaaattgatagtaataatgatctaagtgtttggggaaagaaccatagaagtttagagggtttggagatgaaaaacaaaggacaaaa

SEQ ID NO: 453 - DNA, 4910 bp, Solanum lycopersicum; identical to SEQ ID NO: 269

SEQ ID NO: 454 - DNA, 4384 bp, Solanum lycopersicum
tcatctatataatgtttagaatcttgatttaattaattaaatattagccgttaattttttcttttgttatgagttttcaattcaagtaaaaacttaagaaaatggagagggagttggatccaaaaataaataaataataaaaatttacaatattttttttatatgaagaaatcggggtcttgaagaagtataatgttttgatttggttaaataatgataaataatctaattaaggtgggttctttatactacacataataaatttttaaaaaataaaaaataaagagaaaattgttaatttcaagaatataagtgagcgaaaaagatgaataaaagaattttttagatcaaaagatgaactaaggataatatttttgatattttaccttttttttaattataacgttgttaagatactcaaaggaccaattataagaaaaccacccaaaggtttcatgaaaagattgaaaaaaccatcaaacaacgcaatacaactgctcaactagaatcaacataacaaaaaaatatacttaatgagatcatttataacctaaattataacccctccgtgcactttcatttatcatgttatattttacgcaagtcaatttgattcattttaaaagttaaatgagattatattaatttaatattttaaataaaattttcagatatttaaaaattatatgaaaagtatcatgaattgtagtttttttttgcatatatgaaaaaatacattataaatattagtcaatttttttataatttgactctaaatatgaaaaaaaatgacaattaaaaatagacggaggttgtaaattagcttattaattattaatttgataaatatcataattaactgataatgacaattaaatatttagaagacgataatgacagaaatcaacgttattttaggtataatttttgttgtatttttgaaaaaaataatcttttttctgcaactggttatattaagtgaacaaacaaaaaacaagtagtataaaaaaattacaagtggacataaaacaaaatgagatacagtatttgtgtttccattggaatattagcttgacaaaaactcaaacgagcaacacaaaacaaacagctaaaaaacctgttttgaaaaatccagtgaccaaaacatgtaaatggttttactgtggcctattgttttttcacctttcccaattataaatatccactgcctcaactgagtaaacaaccaaaatttgtgttctataaaaagttttcatatttagtgatcactaaaaaaaaatcaagaagatgtcgactactgtaggccaagtcattcgttgcaaaggtataataattccatgattctgtaatttcctcgttttttttttaagtttgataatttttgtggtaattatatattatttatagctgctgtggcatgggaagctggtaagccattagtgatggaggaagtagatgttgctcctccacagaaaatggaagttcgtcttaagatcctctatacttcactctgtcatactgatgtatacttctgggaagctaaggtaaacaaaactaaattacgggactacgttgagtatgttagtgttgtcagcaaattttataaggggattatttcctttgaactgatttcagggtcaaaatccagtctttcctcgaattcttggacatgaagcagcagggtatgtgttatcttgtttcaattgattgatttgaattcatcatttactgtttctaaagctaaaagggtactgaattttgttgtcttcttgatatttaggattgtggagagtgttggagagggagtaacagaccttgcaccaggagaccatgttcttcctgtctttacaggggaatgtaaagattgtgctcactgtaaatctgaagaaagcaatatgtgtagcctcttaaggattaacactgacaggggagtgatgcttaatgatggaaaatcaagattttccatcaatggaaaccccatttaccattttgttgggacctctacttttagtgagtacaccgtggttcatgttggatgtgttgcaaaaattaaccctcttgctcctcttgacaaagtatgtgtccttagttgtggaatttcgacaggtatagacgaagacaacgatagattatgttactagtttctttttaaggagctgctcaattgttgattgatatgaatacttttccaggccttggagcaagtttgaatgttgctaaaccaacaaaaggctcaagtgtggctatatttggactaggagctgtaggcctcgcggtgagtatgctccgttgtgttgttttattgtttcccgtatatgtgttagtcttacgaatgatctgatctcatttggtcaggctgcagaaggagccagaattgctggtgcctcgaggataattggtgttgatttaaatgctagtagatttgagcaaggtaatataaatttttccttatacattatcttaaaattccttagtaaaacaactaattcatccattttacttgtattctacagctaagaaatttggtgtgacagagtttgtgaacccaaaggactatagtaaaccagttcaagaggtactcaaatcatatttaatttacttaatcgaagaagaaaaaagacaggtctgagttaatagttgatgtcttttcttgaattctgattatttgatcaggtaattgctgagatgactgatggcggagtcgataggagtgtggaatgtactggtcacattgatgctatgatttcagcatttgaatgtgtccatgatgtatgttttctgtaatcaaattaatttccttagctgtatgtttgcgttcatcttaacgaacattgttgtgattaacttttagggctggggagtggcggttcttgttggtgtaccccataaagaagctgtgttcaagacacatcctctgaactttttgaatgaacggactctcaaaggaaccttctttggaaactacaaacctcgttcggatattccttgtgttgttgagaaatacatgaacaaagaacttgaattggagaaattcatcactcatacacttccatttgctgaaatcaataaggctttcgatttaatgctgaagggagaaggccttcgttgcatcatcaccatggcggactaaactttctgtcctagaaaaggagcttctactgtttgagaaaaaagaccaataaattgtcactgtcttattttccctttcgtgtttggttgagttgtaacattccatccatgtctcttcttttgtcttttgcttagatgttgtgctttgccatatctctttcgattcttgtaaaaaatgcaaattctctctgttttatctcaagtatatttacagaatttcagtgatttgataaatctaaactttatcataatataatccaaacagaatttcaattgaaaatgatgaagcccttaccgtcattgttcctacaacataatatactcaaagtttcttttctgtcactcatggacgttgtagaggtcgaggtcgtcggtgctcctcaaatcaatatatacacgagtttctcgaagaataggtctccaaagttgtcactctatatttgataactatttcttccgttcagttttatttgtcaactttgcgtagagatgtcaatatgggctagcccactccattcggactaacccatacagccttcgacattttatgggtcaggccaggctagcacattttttatgtgggccaaaaaacgaccggcccaacccacaaaaacgtgagctacatgtttgccggaccaacccacttttttaaaattatataatttttagaattattaaattaaattataaattataatttaaaaatattatcataaaaatcgacaaaacaataatacatgatgttaatgttactactttttaatcagatccacaattaaaattatttttataatacttattaagttttctttcaagtaaaaatataaatatctaaatagaaatattaatttaattgttttgagtttggactctctttaagtttaaattttaatattatattatatttttaagggaaaattgtatataatagcaaactaataacctaaaataaatggagtagctagggtttgatttaattgtgctccatagcaaaggcttgcaaaaaattgtcaggcgcgtctccccaaatatctctctcgccactctcctccaatctctcgctcgcttcctcactttttatacaaacacaagtgtataaaaattgtttctaattgtataaagcagagaaaattgcataaatacatatatttttgttcccttctttcagatctcgctcgccactctcccaaatctagcttgccaccctcgcctttctcacttatacaaacagaagcgtaatgtataaattgtgttt

SEQ ID NO: 455 - DNA, 6065 bp, Solanum lycopersicum; identical to SEQ ID NO: 274

SEQ ID NO: 456 - DNA, 4380 bp, Solanum lycopersicum; identical to SEQ ID NO: 214

SEQ ID NO: 457 - DNA, 4367 bp, Solanum lycopersicum
tagttggaatacttctgtcccatccatcctgcctacacacaagttattcattctaacctgtctttgcctactaagatacgtctagttcttcctctacttgcctatctcgatagaaaaatttttgataggaaagaaaaaaactgatcgaagcgagagagggagcagtaatgaggaatatacaaataaggtcattttggggaaccattaagctataaaacaataatacacacttatgaattaccgatatataatttaatttggaatttcattcatatggttaatagcaacagagttgtctttgtattagtgcactatcaatttaatacctagctgtgacactaaaaagctaggtgcccacaattattaaaacaaaagtgtatccacctcaagaagaagaaaaaaggcaaatatgatataaaaccatttaacaaagtccatatcacaaaaattagacggcaaaatcatacacgactaatttatagattcactgaaccatgcaattctataccgttcacttccaataaataaaacataatacactatgtttagagtacaagactctccttgcttgaaaaggactaccaagtaggggttactgcagtgactaccaagtaggggttactgcagtcatttgttaattcattttgagtaatgtaactgtgcaagataatgatgttttttttcctttttggttaactaagataatgatggatttaggtagatgaattagacatctagtgataatggagagccagtgcaacaattgagcactctactggaccgacatggacaactgagagaccaacttgcagtattataatagtgcaaattatagtttagtcgactcccttcggaatctactacataaagaactaccataaactatgttagatggctattacggagtttaaattaaactcgaaaatatcagaaaaagaagtaacttcaaccaattacaatgcatacccttatcacaagtgaaaaagagtaaacgtgccaaactcttttgatccctccaaagctagaggaaaagagtgagcaattcactacaaaccactggctttggtctatggttgacacaactcctcggctaattggtcaaaatatcttgtgaccaccaaccagcaagcactaaattggatgttctatcagcttctttacatcataaaacagtgaatactgaacgctgagaggctaactgactgcccaaaaaaaccttgacaaaaagttagtggagtaactacctaggagtaaattcaatagtagaccttgaaaagaactttagcaaagtcatcataaatgctcttcacgtctcatgtactatgttaaggaatggtcacatttctctctgcattaaagctagttcatgttaaaagttgaggccggtagtagtttcaactttcaatttaattccacctttcctggcccacttctgtacggaacaccaatcagaatctttagttcatcttaacaccaaagcatctccacttagacacttactagacttcacataggaggaaaaatatggaactggtggtcctcacacgtacttacctttctttttttacctttgttcaagtttcatactcttttatctggcttcctcactctattttggcccaataggttctcctcacagggatggaaactaacaaatgggaagggaagagaagcattactgaagctgaaaaggaagaggatgaacatggaagtgttgaagaggatagcaaaagaaaaagggtattgactctctctggtaggaagctagttggtgaagggtcggcacatccttcttgccaggtcgatcagtgcactgcagatatggcagatgccaagccataccatcgccgccacaaggtgtgtgagttccattcaaagtctccaatagtacttattagtggactccagaagcgattctgtcagcaatgtagcaggtaagtaacccctaatttctgatgattatccgtgccttccgagttgtatagtggagatatcttggaaactaattatgtgcactcatcaaacagtttttcttagatttaagtcatgaggaacattaatcaaaacatcaattagccaataaacaaagaagaaggtaatttaagcttgagtgttgattcattttgtgcaacatatgggaatcctaatatcaagaaccaataccaataacacaggcaaaaactaatacatagagacacgaaagtacaacagcaacaatcaattttatacaatatcctatgcatatcatttattttatcataaactgtgaaaaagcaaaagtgagtcttttaaatcgtgatataacaatgaatccaagacactactggatcttttaattaatccattgacatttctagactattaactttgaaatgtggttattaagattatggctacatccaattaagagatagttgttaacctctaggtttccttgttatggaacaaaagccaaatcaagcaatgatgatgacttcttagaattaatctcactgtccaatgggtcttcaagttgaccaaaaaaatgtgaataaatattgctaacatggagaatggtctgtatggttgcgatagggcttcttgatcgtcccttctttaggtagtagaaggtaagctttactccaactgaaattgtatacaaaagattcttttgttttctttgaagggagagacaaatactggtaagggaaagaattaacttttgcacatgcaaacagagattatccttcagacaaattttttgttccaaattcatccatctgacaacgaggtattctaaataagattctacttcctatgaaagtatgtagtgtatctaatcagccaagaaactgtagctgctgccacatccacagccatctcatgtattttctaatcagctgctttcagattcccaagtataggagtatatcattttctaatgagcaggggcaaaacagagcttttaatgtgaattttcaattgttcgcatgatgaggtgcagatttcatctgttagcagagtttgatgatgctaagaggagttgccgaaggcgtttggcaggtcacaatgagcgccgccgtaaaattacatatgactctcatggagaaaatttgggctgaagaagcatcagcatcaatggcagccaaataacctactttctgaagcaacataaacaagatgtgggttaagcatgctctctatcttctgtcaattcccggatttctaagcaaattgttatttgtgaccttcaagtatctagctaatagtactttcatttcccttgtgtaaagggaaggacaaaaagaataagccgttggcactgtctgctagtattcgaaaaatgaaatatttgtagtatgaatgcatatccatgttgacattccaactcactttatgaggtttttattattatttttctcttgttgttataattcctgcacttccataacttctttttttgttttgataaccacgaaattcccgaggggaagtggcgcacaatccaaacttggtgaataatgggtcctccctgtacttctctccatttaaattgcaggttttgtctgtgacagggttcgaactcgtgaacgtgcgcctacacacatcacaacttgtgctctgaccactagaccaaagcctttgggccatgtatttccagaagttaggttctatgttttgagatgcctcttggcttatgggaacagaacaactctcaatgggtttataaacataatttctatgagataaataagtatgcatgccctgttaaattgaggcatctttcagagtttgacctatctcaggcatgtttgagttggcaaaaatgtgttttgattgagatcaatgtatgatccaagaggttttaagctaaaagcgtaagggctcatttggcatgagggttaagggatatcttgggattgattttcggatgagtttatccgtcattcccatgtttaattgggataaaattgcaggataacttatccactgattagttatcccgggattgtagtgttatttttatcccacattaaaggtgggatatgaatcctgggataacttgttccccgatcaaacaagccctaaaagtattacggtttacaattttatttatcgtacatcatcaaatataaatgagaccgctaacataccaaacaatggtaagtggaacttaaacaataagacacaaacgccaaatgatcacaatttcttttaaaacagcaacaatcaaacttcaaattggccatcaatggaaaaacagagaaacttctaggacaaagcatgtaccaaatatcttcaaaactatgttgacatcttttggagttcttccccttattaatatttagcccctaaaatgacttgtgttaggcccaaaagacagtgtg

SEQ ID NO: 458 - DNA, 5624 bp, Solanum lycopersicum; identical to SEQ ID NO: 292

SEQ ID NO: 459 - DNA, 4858 bp, Solanum lycopersicum; identical to SEQ ID NO: 295

SEQ ID NO: 460 - DNA, 7239 bp, Solanum lycopersicum; identical to SEQ ID NO: 296
  modified_base (1278)..(2122): a, c, t, g, unknown or other

SEQ ID NO: 461 - DNA, 22649 bp, Solanum lycopersicum; identical to SEQ ID NO: 299

SEQ ID NO: 462 - DNA, 7670 bp, Solanum lycopersicum; identical to SEQ ID NO: 300

SEQ ID NO: 463 - DNA, 4930 bp, Solanum lycopersicum
tacaggttattatttaatttttaaatataaatataaaatatatgaaaaattattatattcatctgaattcaccaaaccccacctaactccgccataaaatccataattcgacagatttgaaataacactattagaaagtgattttgatatcaataatttgtgcaattagttatcatggatcctttttgtagagaaaaatactttccagcaatgaaaaagttagtgttttagaattattttttccttttgttaaatatggtaggtagttgaaagaatttaatatttagaaaaggatttaacattactgaaaattaatgaaaaatagttagaaataattgtcacgaaaattctaaataagaaagacataaattttgtttgaattgacttagtaaaaatagtttttaaattaaaaataaaaaaaataaattgaaatgatttttaagtgaaaaaattaattataaaatgggaagagatctattttttatatttaacttattataaatatcttgtcaaatatgcttaacttattttaagttatttttttatatttattaaatattttcaaaagtcaaaactatataaaattatgtttattcaacttttaagtcaatccaaatacattcgcaattaaacactttatttttatctaaatttactcgtcaagttttgaataattgacatacttattaaggaaaaacaataattgatataattactcttcattaaattccaaatatttactcaccatatttttcaaatacatgaattcaatctataaattgactgtataataattaaaaaaaactttgtaaagtctaaagaggagatatattaaaccacgagagaggtaaatgtgatagagcgaaacataacaaacacaaatattttggatgtgatagaggagaagttcttttccctaaaatacccctagatattaggcaggctgtttttatataaagcacactgtcactgatattacaattatccttgcatctcagggtgacgccaaattccacttgtcaggtttttctctatctcttcaacttattattttttttctcttcttttgatcaaattatgaaaatcatccattttttttacttgttttctgagttgaaatattgcaatgattcttcaacagaagcacactactttttttttttttttttgtaaatttgagtttgtgcgacatgcatgtcggtttttgtttttatttgaaaattttagtgtttctatagctagttttttttttgtcttcttttgttgtgtatgtagatctacaaaaaatttattactgaatgagttgattttttcgcatttcactgtagtatgatatagatctgtttaatgtactttttaaaacatgctttatggtgttaaaagttaattttaagctaaattgtgtaaaattctacttagttctgtttgttttgggggttttcttttatgttttttagttatgtgatgattcggcttaaaatgttgtaaataagctagttttgtgttttactagtgagtgagtaatgcttgattgttgaagatgacagtttacctacttcctgaagcacgtggagatgggaatctattagttgaatttgggccacaatttctaatgattgagataatttacttgtgtttagttgaaaagggtgggttagatctaattatgatgaataatttagaaggtatttttaatgattacctcatgcttggtccctcataaaagttgcttatcataattacttgtttatggacaagtgttaatgctaaagttgatttatttttcatgattattgaatatggaatagtggtggttgtggttaatgatttgctttgctttagtttttcaagtttcatgattaaatgatgtaagctttatgagtggatttgcattcttgtatgtagtccataacatgttttcatccttgtggcagttctgtttggcctctcttgtttcaaaatgacagatgttcaggctcccccccctcgtcctaagaggaagaaaaacattatggaccttcttgtccagttcagatggattgttgttatcttcgtcgtccttcctctctcgttcttgtattatttctccatatatcttggggatgttaggtctgagtgcaaatcatacaagcagcgccagaaggagcatgatgaaaatgttaaaaaggttgtgaagcgtcttaaggagaggaatgcatctaaggatggtcttgtctgcacagctaggaagccctgggttgctgttggaatgagaaatgtggactacaagcgtgctcgtcattttgaagttgatctttctccatttagaaatgttcttaacattgacacggagcgaatgattgctaaagtcgagcctctagtcaatatgggacaaatctctagagttactgtccctctgaatgtttcccttgcagttgttgctgagcttgatgatctaactgttggtggtctgatcaacggctatgggattgaaggaagttctcacatttatggactgttctcagacactgttgtgtcttatgaagttgttctagcagatgggcaggtagttagagctacaaaggacaatgaatattctgatcttttctatgctattccatggtctcaagggactctagggcttctggtttcagctgagatcaagctcattccgatcaaggaatacatgaaacttacctacaaacctgtagttggtaatttgaaagagattgctcaggcttatatggattctttttcacctagagacggggatcaggataaccatgagaaagttccagactttgttgaaaccatggtgtatactcccacagaagctgtttgcatgactggtagatatgcttcaaaagaagaggccaagaagaagggcaatgtgatcaacaatgttggttggtggttcaaaacctggttttaccagcacgctcaaactgcactcaagaagggagaattcgtagagtacatcccaactagggaatactaccacaggcacacaagatgcttgtattgggaagggaaacttatccttccatttggtgatcaatggtggtttaggtttctctttggatgggccatgcctcccaaggtttctctacttaaagccactcaaggtgaatacattaggaactattaccatgaaaaccatgtcattcaggatatgcttgttcctctctacaaggttggtgatgctcttgagtgggtccaccgtgagatggaggtaaaagttcccattgttttccatctttcagtacttctgattatacaagtgcatcattaacaattttatttttgtttaggtgtatcccctctggctctgcccccacagactctacaggctgcctcttaaaacaatggtgtatcctgaaccaggttttgagctgcagaagaggcagggtgacacaaaatatgctcaaatgtacactgatgttggtgtctactatgctcctggacctattttgaggggtgaggtctttgatggtatagaggcagtccgtaagttggagagttggttgattgagaaccatggattccagccacagtatgctgtctctgagctgacggagaagaacttctggagaatgtttgatggaagcctatatgagaactgcaggaaaaagtatagagccatcggaaccttcatgagtgtgtactataagtctaagaaaggaaagaagacagagaaggaggtgcaggaagctgagcaagagactgctgaagttgagaccccagaagttgatgagcctgaagattgatcgtgttctcatggcttttctgccttttctcatttatttagttgtgattgtgtggatgctcttagtttccttggtctgtttgtcattgcatctttttgaacattttctagccttgagcttgtttatttccttttaaccagctggactggactggcttagttcaatgtgttttttttttggcttcacccacctcctttccaaaatcatatcaaatgtcagcctgctagacttgaggctcgtcaaaagatactgtcccttgaggaaattttatacggtatggatgtatctataagattcaacgaactcttttagtataacatcaagagttagatttccaacaaggttaagtaatataaatctaactaaagaaaataaggttgaataagagcataagatgacatatttatcggtcgaaaagtgatgttcaccaacgttccaattaaaagaaataatatatgaagtaaatataacaagtaaaaataattgtatcaaaattgaatttgaccgttggatgattgcaagcaaaagatgattctattttaaaaagtcaaagaaatgtttaggcaattgtaatattttgtcacaatgagtggccttttaaggcaattcaattttcagagaagattttttaatattaaattaactatttgttcaacatcaaatccaccttctggcaccagcttgtatatccgtgatgtgataacaaatttttattcttttttatttagtatgtgttagtcataaatatgatatgacaaataaaaattgtacgaggctctatttcattcttaatcaaatgaacaattggggagaaaattatcaaaatgatccttaatgaatatgagttgaattattgagttgggaacaaaaataagccacaaaaatataagagtaattaaaataagtcactattttagtaagtaactaaaataagcttagtggaagaaaaagtttcactatattcaattttctaaacgtttttcgttactatcataacatttatttttaatatataaaggaactttttcttccactttataaagtggaacttcttattccacttttataaaatggaagaaaatcatcaactttataaaaagttaccttttcattttcacattcaccttctctcctttttattttcatggcttccaaaaaaaaatcactttgaagatggtcatctg

SEQ ID NO: 464 - DNA, 2969 bp, Solanum lycopersicum
ttctattttcaacctaacccgctcatttgatacccctacaaatatcatatttgtgtgtgaaatattttttgggctggagagagaggccccgaggggagtggaggggtggggtggggagagagagcgagaaagagtggagagagaaatttgatatgaaatcctacatatattacagattgtaatgttctaaactataacgatttgtcataaacacatatcatggatttgtctttttgtgtaattttcccaattgtaaataggacttcgttatttgaaacttgaaagtgaagtcacatagattaagtacaaacattaattaaagaccgtggtggaatgataaatatttatttatctttaattagttatttttttgggagctctttattccaatgtgagacttttgcgacatatattcaaatttaatcgaatcacaatatgtattagattgataaaaaaataatttttttacaatgttagttgagactcataacttactgcctattggtaatctatgactcctaattccttaattatttaaatatatcatcttgatcgttaacaaagtaatttcgaaagaccacgagtaagaagacaaacgagaataccaaaaaattcaaaaatttaatgtgatttggtcaatcgatctacgtccataaaggagatgagtaatctactataaatatgagagtacaaaatacagagagaaacaacctcaactaattcactcggaatacatgagaagttcacacaagtgataacgtatcaaacttgtgacccacacttttccctctaaccaaagctcttaaaactatattgtgaatgctgattaagttaaacgaaacagtcctaaatcttttccgtcctatgagaaacaagattaatcaattcacaatttttttaaaaagaaaaacctgtaagaaatttaggcaaacaaaacctaacacaagtttgtttttgtttttactaccaacaagaaattcaaatggcaaatgtataacgcatcttagctaattatatgaccagattcagattaatatacatcttcacccatgcaatccatttctatataaagaaacatacacgaacttgatattattagagattgagcaatggagggtaacaacagcagtagcaagtcaaccaccaatccagcattggatccggatctggacagcccggatcagccgggtctggagtttgcccaatttgctgccggctgcttttggggagtcgaattggctttccagagggttggaggagtagtgaagacggaggttgggtactctcaggggaatgtccatgacccgaactacaagcttatttgctccggaacaaccgaacatgccgaggccattcggatccagtttgacccgaatgtctgcccgtattccaatctcctttctctattttggagtcgccatgacccgaccactctaaatcgccaggtatcaaattcctttggtgtttcattttatgtgattaatattaaaaaatttttatataaatgtcatgatgatggttgttgctagggtaatgatgtgggaaagcaataccgctcaggaatatattactataatgatgctcaggctcaactggcaagggagtcgttagaagctaagcagaaggaatttatggataagaaaattgtcactgaaattcttcctgctaagagattttatagagctgaagagtatcaccagcaatatctagagaagggtgggggcagaggttgtaagcagtcggctgcaaagggctgcaatgacccaataaggtgctacggttgacagcagatctttgaatgtcatagcaactacaaaagaacttgttagacatttgctgtcttgcttctttaaatttgaataaacatgacaatgattcttataactacttgctctcttggatggaataactagttgtcgtaaagtattctcctcttgctaattattatctctctttatatggtacctgcaatttgttgctttagttacagaataatggacgtcaattctatatcttaatttgttttaagtcttaaatgaggtggtttgtgtttgaaagcaatatcaagcatagtaataccaatgatttagtagatgaacttaatcaaatcaaattccaaaatgcagtctacaaattgacaacatgaagttaagtgtatcttatgtaaattgacatctttcctagtagatgcctaatacttttgtaaagactaaaataagcacagatgaggctgtgtgcatttaacttagagttcatccttaggtgtggctgcaggagaccctgtagggttgcttgaagtcttgatggggtaggagggttgcattgctataccacacaacccctcttcagcgtcaaccttgcgctgcattctaatgtatcctttttctccccattcagctccccatgagttcttcacaatccagtatttggttccatcgacggttgtgccataccccacaatagccacaccatggtccaactcagtaccacattctccggtgaatacgccctgccatgtttacagtttcacaaatgttaatagctagtaaacacttttgaacttgagagacaatggtgtatcattttacctcagagtagaactggaactgagaacctgaagcgtctatagctacagaaataggctggttggctactgctttaagcagtgcatcctcatcattaggaggaacatcctcgtgtccgtcaattgaaaccaccggagtattcctctgttgattcgataaaattcatgcccatgtattagaaacaagactggtctaattaagacatcctactgatgcaatagtcttaccttttgaatgtcacacttgtcatcttcagccttataaggatacctctcctctgttgtgatgccgcccctcttcttgatgaagtcaaatgccgggtccatcaatcctccattgcatccttggttttctgtagtgtcacagtcaacaagttcttgctcc

SEQ ID NO: 465 - DNA, 10145 bp, Solanum lycopersicum
aaaaaaaaaaagaaaagaaaaaaaagggccttcttcgccactagcggtgtaattgggaaatttggtgtataccgatgaccgaaaccccttttccctttttatgcaatgatttctctgaaaccctataactcttcaacttctctaaaatcatccattttctcaacttatcactacttcttcctttaactctgcagattcaggtgaaaattttatcttcttcttaatactacttataagtttgatactacttgtgtttgtttctcaacttcatgtattgatcacgggttgtgtttagtttgcaatttgaggataacccatcttgattatagattgcttttttctactttttgggtggtgggggtgggggttactgagatcggttttacagttcaagaatgttggattttgatctttcactctaatccggaagagtatagttgatgtgcttatttggtattctttttgcttatatttcgactcacttattttagtttttgagccttaaaacatcatccattttgttgggtttttggagaaagtttcgtctgttgatctttgaaaaggagaagaaagaagttatctttttttagtttcagctgtgtaagcagagaccattttgaaattagtcaaatttaaacactaaatgggaaaaggctttttttcggcgatgaacagctgctttttgttgttgaaaacgctgatcttgaagttgcaatcttagtgctactctctgtctcctttatttttacttaccttataaataaagtagacatgtttagaaagcaaacatgatggtatgacatagttcttatggttactttgtaagaaaaactaaagctttttgtttgctatgggtaactgagattacctctctgggcttgagtttggttaagtagttgattgattgaagcttaattcttattaacaatcacaaatggggttgtagagtatggggagatgacccttttcattttttggtgcaagtacagatggtcgacgtctgacggaagcttgttgaagtgagaaaagacaatcttacagattgaaaggaaggcagtttacttggtatagactagtgctttcagatcacaattgtgacatggctgcaaaaccaattgacgataccatatggaggtaaattgaaaacctataactactatattattctttttccatactacctcttacctcttctggaggaggcattgatgaaagctgcaactggatcttattcagttctagtatgatatctggttattctcatttcacaggggtagtttcatgatctcccgtccagagatgagattgaatcttacagcccatctatcaagtaaagcgtgcgcaaaagtatggctggcagctaaagagatggcggaggtgatctatcctgaattccttcctaagcgtgatgtgtggccaaagagttttaaaagtgctaaactgattgatgataatattgccatttatttcttttcagttaaaggcaggtatggtaaccaacctagcataaatctttgcgtcttctgttataccacctctaatcttggtatggttttgtctcagagatgatcaagtttttgaaaatctgctgtataatttaagacactacgacattgcattaagagctttggttggtgattctgaactcctgatttttacttctgcccatctgccagaaaagcatcacagtaatgtttaccatcccaaagtcttgaatagacaagcttcttaacatgttcgactaaccacactgaagttgcaggatttgagggtaaagtatatctatggggcgtctttagtggaagacaagctcctcctcaagagtctcctgatgattgttttattcataatacccgagtgacacaagcttcaatcccaaattcagcaaacgatgggaaggatagaagttgcaaggaattctccaataggaaagatccttgtaagtctagtttcaaaaaaagaaaaaagatcgttgtaagtctttgagtaattaaacttgttggctgcttgcttgttatgctcacctgtgtaatttagcgaatatcacctacatcaagtagtgtatcattttgctggataatgtggatagctacatttgtttgttgtatgcatgtaacttgaaaggaaaatattttgcgatgctagcggttaaactgaagtttgaagatacatatgacattaggttcatcaagatgttttaactgttcattttgttacttctttattttcttttctgatttttcttttctgagaatgagttttctgatttgattttctcagttatcatagaaaatagtgttcacctcatcttattgagtttggtcattttatagtttgaataatcaagggccatcttgaggagacatgtagttcttgtccttcaaaatcagaaatggttgcaaatgtgcgtgagttggtaaaacaagtgaaaagagaagctagtggaaattgatagtaaatggaaaagcagaaaggaagatctatggttgggcttctctgtgagaaaatgtcatataggatgtgtaaaggcctgtgaagcatgcaagagatcatttagcactacaaaagctcactaatcactcaatacagttgtaaaatagccaattgaaaatgactgttcatcagtgtagtttagtgcatcagaaaccaggagtttggtgtagttccaatagttaagtcatatcttgatcgacctttcccttctttctagaaacaataggtgctgttagaagcaaacatataacttgttcgtggcgatgtactaaataccactaatttaaccaactgtattacagatacaagactaatggtaatgtttcagaaagatgtagcttaagaaattccttaactttcttgtcatttgtcatttctatatgaatttaaagtacttcatttattgtccatgtgcgaaagaaatctccattgaacagtattcgtatttttgtccttttcctattcttgtgtttctttctggcctcatttcagaggggatagttgagtttgttttaggcacaatgttaaatgtgttccttataagcattgttttacctgcaattgttttaacggaaaaaggataaatatatccttgaactatcatgactggtatctaaataccctctggtataacttttggatgctgatgttcttaccgtctaagatttggggtatacataccctttgtactaatggaacacgtgtcgtgatctttaatggtttaaccaaaatttaattaatttttattcacaattagataacccacttatcttacacaacccaacccgtgacccgaattaaaaacctcttcttcttctcccgcaatctaaactaacaaaaaatcacagaactcagacattgaattcatctatgtgctttcgagcaacagatacacatttatagagactgaactctgttaattgataatgtactgagaaattacaacatctagagcataagaacaacagtaaagagaattgacacaaccattaacgctattgcaaactaaatttacagttactaccattactccaacctgaagaccacaatctaaacaccgaatccaagtcttctcctggtgtgctttatgcatatgtatacatgttttcgattctttcttcaaaataataaaaagtcaaaagatgcagacattacaattttgtaatataaacatattttcaacaattgttcatcagctttttgtgtatttcctcccgctccgtcttcttgattctctcccttgcccaaaaaccctattcatcacactcctcaatttcaattttcttgtacccttaataaaatccctttctttcaagttctattttgtcaaattataagtgcatagatcagccattgttgatgttggtaaactgttccaatttctctaccccattacagctaccacaaggttagtggctgacaaatcgcacttgaagaaagaaaattgtgattgtttgtatatgtatacaagaaacatagaccagcctgaaatgatccatagtcgggagtaagaaacaaaaataaacatcaaaattaggtccagccgcccacagaatctttttttaattttttcaaatccatgaacaaaccacttaattagggtggaagaagtgttataattcgggtcatgggttgggtttaattgtgtaagatgggtgagttttttaattgtggataaaaaattagtttaattttgggtgggatgttaagatcatgacacgcgttcatccgttagtgcaaagagtatatacgctttaaatcttagacggtaagggtaaggacatcagtgtcctaaaagtgtaatggaggttatttagatagtgtatatgatatttcaggggatatttctccttttcttgttgtaattattactaacctttttcaaagtactaaccttcctaaatttattggtaaccctgtcttgaatttggtttcttacttgaggaagttggaaatccgtggtacaaagtcagattccttttttttttttaaaaatagttttcaggtgtaacaaggatgcccctatcagcatagatggttttattttattttgcctttgggaatttttttggtactatgtatatgatacatgattgttgtatattagcacctttggtgcaaatcaataatattgaataaaatgtgctttttgtaacaacttaagctcctggatgtgatgattacacacttcagcatgatatagtatcaggtagaggttctgagttcgagtgtcctgccacccattataaaaaaagaacatccacgtgtttggtctatggaaaagaattaggcccacacatgaggggcgtgagatgagattatataatattacttttgaataaaaattttaaaggaaaattcacaactacgggttacataccaatttgttagtgtctattttgaactttagtagtgcttccatcacgcccaataactagtttctttgcttttgtaacttgctcttgtacttattcaatgcatggatgaaaaagatttttcttgtactcatcccttcaaatttgaactttgaagtatgatttttttttaaaatttggacatcctcctcttgcttttttgaataagcagcaactgcctcaaaatcggctagaaagggaagaccacttgatgacgcttggcaacatgctactccagtagatggaaagaagcagaggacagtttgcaattactgcggatttatctcttcctctggaggcattacttatcttaagacacatctgggtggaggtgatccgacgggttcactgaagggttgtccaaatgtaccaccagaagtcaaaagggtgatgaaagaatggttactaggaactataagaggggggaaggccccacagctacaggaaatcaggactgactttgaaggtatgtttctgaaaatagggatgcttctatgtatactttaatatggaaaactagttgtatctcgacaggagtcttttgctccacaaaaagatatttatttctatcagaatgagagaaacagaagtgttctgagcacactgtttcttgtctgtcccatagcttaattttggatggcttggaactgcacttttgtagtttgaacagggtgtgcagttggtgaagagcttgtgtagattaatctcttttggctcgtcgaagtattttgctgtttgtagattgactagagacccttccatatcattgtatacttgctgcttcacacttttgatagcaattacagccagttccatgcttataacaaaggagatttttcttatgagaaagagttaagccaacatacatcagttctgtccttttaagagtactacaatgttcaatcaccattatgacttcaatttacaacaatatacatcaagtaggattaatactagtaaaagcattcatgtttaggtcttattggcaattcatcaaacacctagtgtgcataaaacattacaaccttctttctatgatgtttcttcatctaacagcccttcttcttgccaactaacgatacaaccggtattcgataatattctctcccacaattacaagttatatatcccttactctttttaagtgtaaaacataaaaggactcattcgtatataatacacttatttattaattctagactagactggactataaaatagaaaaatgcatatagaataatcctataactcttcttacttggcccaattgtatcactcgacctataattctaccatttaaatcatttcttctttcaagaactgtaactcagtgctattacttgtacaaatggtggtttcaacctcactatacctttcaattaccaagttcagaacatattcaagtgtgagatgaagaattaacctcttgatagccaaatcttgaatttcagatttcatggtgttctttaccaaaaaatgaaggttcaagcaagaatctataatcctaaggtttaatcttgttatgaagattcgggagttgaaactaactcaaaacaccattaaaactcaccttggagtgtgttcaagttttgacgaactccctttctctaggacatttttcagacttggggaaatgaagaaatgggccccaactagcctttaaaaaggcctcagtttcctacgtggcctacacagccccctacgtgatccatgaaggtctttttggttgcgtaactgctctactactcttcagtaaaaaggccataactccttatactaatgtccaaatgacaaacaggttgaagcattggaaactagtcttaaagaaatttaaaaatgataggttatgcaccacatagctgtttatatccatggagatattttgattgacgttgggtcttgtgcaagctcatttaatccgttacgtagttccctacttggctttgttctagggctctccttacaccgttaatctcttctaaagttctaatacaccttccatcctcatcgtcatgtccatgtgataatatactagtctgtaccctccttttggcacataacattatttctggtcgtcgtcactttatttaatcctatctgttcaagccttggtggacaaagtgacctctatcggcggaaggtaccaggtacctcgttgtattagtcgagttgctgctcctgacaccacgattataaaataagtgaggagttgaaaaaaggcactttcggttctatccactttgttgtagatttgttaatgcatatcagaaagagagaaaagcaaaatattcactgagtgcgagttggatcattcaattttggctattagaatgttctcattttggatagtttggagaaaattttcagtcagcattcacctcgtagaggtgaactctttctacatcaatactttgtcagaaaaaaagaggaaatgcattggaaatatgtgctatggaaattagtaatctttcatatgaagagccactcctgatatacgaggtccgaaaaaggctgagcacatcatgcttattgtacacaaccttattttgcatttatgcaagagattgtttccacggcttgaacttgcaacgtccttttaaagtcaaatccaagactagttcatttccttgtgaaagttggaaaagattatcccacgaaaatggacaagtgctttaactctttttactgggcttgtttattagttcagcttgctgttttatttgtctttgctattacataattttggttaattatattccctcttcctctaagggaggaataacagagtcgtctttgcacatttatgtacatcaatgaatttcctcttgaaattttgaccaccacctttgtacagtgcatatggaagtggcatcctttcctgcatgtatttgctaaaaaatttattacgggttcgaaacaatttgttttgtttccatcacacacaattatccacttttttctttatttttaatataccccaaaaagatttaaggttattgtgccaagattgctcctgctttctttttttcttctgtttaaacttttttctaaatacgccctctctcaattaagatttaactcagggtgctattgtttgtaccttcttctctaaattagcagtacctgcatccaaaaaatcagttagaaggggaaggccacttgatgctgcctgggattatgctacaccagttgatgcaaaaagacagagagcagtgtgcaagtattgcggtttcatatcttcttctggaggaattacacatcttaaggcacatttggctggaggtgatccaaaagggccctcaaaaggttgtcccaatgtgccgcctgaagttaaaagggcaatggcagaatcgctcaacagaacagttaaaggagcgaaatccatgcagccagatgagatcaggaggtacatgaaaggtatgtttctagggatataacacattcagaacatgctttcatgaggaagtgtgcaatatgtcgacgaagttttttgtaccatatatacaactataatatatcttttagtccccaagaaaaacgaagggttcttgaaaattttagaagtaggtaactctttagtttacatagaaatttgcacgttttcttgctgtacatatttagttttcctttcttgatataataactactttttcaaatgtttcagcggaaaatgattggtctcctcccaggtcagatgactactcgttgaatcaacatagaattgtcaagaatgctcagtactcacattttgccaatgggaattctgttaatgatatgaccctgtcaaagcaatcagagactgcacatgttgatagttatatggaggttatgagttctcacaatgcttgtaagtcgagcttcttaagcaaaccttcaactcgagtaggttttatttaacgtgtgcatcagtaggttgaggactaagagctaggaagtcgcttaaatctaatggtgggtacatgctccattaatttatgacatgacaaaacatacatgaggacagatgaaaaagttgattgtgctactttatcaacaaagaggttcttttgatgtacaaacaccttttaacccaaagcttgacaacgacaacatggtgacattgcttgtgattattgtatctatgtatttattgcgacgttccctccagtttggagtgattttgcagttctattaaacaggttgagaatctcctctttagtgtacgaacatttgaaagttctgaagttgatacttgctcagaaaacttggttgatactgaattgaatccgacattatcttacactcaggtgtttaaagatgcaaatactctttgcatatcagttggagatgaacgtattttagatattgcatgacaggttgatcgtatttcgtttttggtcatgagtctggagatgaacttatttcagatattgcatgacaggtcgatcgtatttcgtttttggtcatgagtagtctcaaaggctactattatctagctttattgtcacatctatatgtgaaatgtgcaacattctcaaagcttgtatcttttaaaaaaagcatttcatatatgtatttgttcctgaatgtctagttctggaaatgcacgagtagatccagacgttaataataacaaaagcataaaaatgagtctcgacatatgcatacgacaatggaagagaagcaaacttgaagttggaattgtttgaactttagatctctggactttttaagtttaggttttgacaattccaacttcaatcctgtatttcttcatctttttagagtcttccattttctcaaattacttgttgatttattcatgattatgatcgttattgtcaaagactttgttgtgtttgaagcatgaatgtaattaagaaatcttaacattatttatttatcaaagaattattaatattgataaaaaagaaatataagtgaattgatttttgatcctcaaaatatttaatgatccaaacgtcaagagtatttgaagttcattttatccctccacttttagatacttgtaatccaagtctaattttcgtagtgctacctagatacatgtcgttagtcgttgagcattgaatcagtttccgtctcaaacaacacagcataggaatcacaagttacaaaataacgtaaattaatcaactcatttattgtgtatctaacaagttaaagatgggactataaaaagataagagtcgagttttgaagtatcatctggaattgcaactcaattagctttgagta

SEQ ID NO: 466 - DNA, 2994 bp, Solanum lycopersicum; identical to SEQ ID NO: 225
  modified_base (2655)..(2994): a, c, t, g, unknown or other

SEQ ID NO: 467 - DNA, 6159 bp, Solanum lycopersicum
tcacgtgtcagatattgattcgctctttgagccaagccgctatatttaatactcataacttttttttaaaaaaagattcacgtgtcaaatactgatacactttttttgccaagcgactacgtatcagagctagaaaatatcttctttttcgaagattttacgtatcgaaagttgattcgatttccttgctaaagttattatatttatgagtagcacactttaattttaagagaaattatcaatattagctattcagtagatagcactatgaaagttattgaagtgtgcaataaattacatttttagttaaggtatcaaattaaaataaaaatacaatttaagggaccacatatatgaatttcagcctctataaaatgatgaaacttagagggaccgtttggtatgcttgataatatgaagtattccatagttaagtttaagcttagaattatattctatttgattaacaaggtaaattcatatagttaatcaaatacgatataaatttagttagacttaatcttaaaatatctctatcttattccatttgacttgtgattaatttacaccacttctcatgtctaaagattataatcttagcactatcattttgaaataatttaatttgtgtatcaaactagagtattaaatagaactaagtagattaatgataattttcttaaaataataatttgtagttaaaagatttgcttctaattaattttaaagtatactttatagggaggttgaagaggacatttaagagtagaattgtgtctaagttctcttcatataaggtttgtaggacccactcaacccccaccccctacctccccaccccccaaacatagattttcctgtcttttctacctctttttttgcttacatttttctgctctctgtataaagtcactctctttttctctctatgaaacaacactgcttcaacagttctactttttcttcataagagaaatttctgttcttgaaattaaagttgcattggagctcagaagagaaagtaaaaggtaataaaatgaaaagggtgtttaattcttgaagaatcaatgaagttctctttgtcttttctgttttgggtgtaaaaatctcatcttttttgcccttttgggtgtaaaaatcctatcttttttctttttttgagtgtaaaaatctaatctttttcactttttgaaatgttttagcttgtatacaaggaaggtggtgtattgaaatgggaaaaaaaaatatcagtttttacttgaagaaaatttttaattagttgattgaaatccgggttgtaatgtggtacccggattttttatatattgatcattggatcctttcatcttgttgtaggtacattgggttttgttttttttttattgagtagttaagtatttggagcttttgttggaaaaaaatgtttttttgttcttttttttttagttgttttgataatacgaatgctggaaaagaggatgactcaaaagacctttgtaaatgtttatttgccttttttttttttggtttatgtttctcagataatgaaagatgagtttttttttctttcttctttcaggtaaatttagctcaccgtaacttcttttctttatttaaactttttttttcgagtcgagttctatcaaaaacaatctttttagtttttgaggtgaggtaaagtctgaatatattctatcgatttcatttactatttgtgaaattacattggttatgttcttgtatatgagttttagttctattagtatttatttgtttatgttaaagtttcttgttaatggggtttagctttgatttttaagtttttttggtttttctttgttttgtagttaaattggttgaggtggacagtggatttctcagtcctcttgtactaagttatatttattagtggttggttatatttagtcttgtggaagtcaaaattttgatattgaaataaatagttgccttttaagttgtggccttgtggggcttagttggtagatgacactttttaagcctcttcctttccccagctcatacttgtagtagtattcctcggtttcattttatgtgtcactcagttagttcgtgaaaaaatgtgttattatttttggtactcatcattttgtaacagttatcacattagttggttattgttattattccattttctctatgttattatgctttccctattgttttctatgcccttttttaacttttatatttttcttttagctgctctgatgtgtgtgtttttcgaaaataatctttctacttcctcctggtaggtgtttctatgtcctctttacttttgtattgtgtgtgtcttttagaaacaacctctctacctcctcgaggtaagggtaaagtatgtttacactctatcgtctcgactacactaggtttgttttgtaggttcttccttttggttattaaccaacttatgttaattgcaagtggatgttggtgcatgcatttgtgtatttgtaatattttataatgatggtagtgtcctttttttaataaattgtagattcttgtgtatttggtccagttactgagcatatatggtttgattgatcagggttgtacttgtacattaagcagcattggtgtaaacaagagtagttctattggatgcaatgatgaagaaagtagtatcatggttgttgtttttatcgatcgttgcttccttatgggttgttgatggttatattgaatgtccttgtgatgatagtgatgcattttttagcatggaaacaatgttatttgttcaaaaagccggtgatctcggtatagcagtggcctatttttccatcccaatcgagatcatctacttcgtttcctgttctagttttccgttcaaatgggtgctctttcaattcggagcattcattgtactttgtggtttaacacattttctcaccttcttgactcattttggcaaatacacatttcaccttattcttgcccttattgtttgcaaactactcactgcattagtctcgatgctcaccgctataacacttatgaatctcatccctttgctgcttaaagccaaggcaagggagtttatgctgagacgaaagaatcgtgagcttgatcgagaagttgaaaaaataaaacaactagaggaacttggactgcatgttaggatgcttaccaatgagatccgcaagtcaattgatcgtcatacaatactctacacaactcttgttgggctgtcgaagttattgagtttgcagaattgtgttatatggatgcctaatgagaacagaaccgagatgaaactgactcatgatactacaagggagaatgtttccagtgtgtataatgtgcctatcccgatcagtgatcgagaagtaaaagagatcaaggggagtgatgatgtaaagatacttggtgcagactcccgacttgctgctgcaagcagtagagggagttgtgagccagaatctgtggctgctattaggattccaatgctgacggtctcgaatttcagaggtgaaactcgtgagattgtctcgcaatgttatgctatccttgttttggttcaaccttgtggacatggtaggttttggcttaaccaggaagttgagatagtcagggctgcagccgatcaagttgctgtggcgttgtcccatgctgcagtggttgaagaatccgagtatatcaaagacaggttgatggaacagaatcaagcactgcagaaagcaagagaggaagctcttagagcaagtcaagctaggagttcatttcagacggttatgagccatcgattgagaagaccaatgcactcaattttgggtctgctctcgatgttgcaggaacagaagttacgagatgaacaacagcttcttgtgcattctataatcaaatccagcaatgttgtctccaccctgatggatgatgtgatagttacttcaaccaaggagaacgtaaaattcccattggaaatgaagcattttcagctgcattccttgatacgagaagctgcttgtaccgccaaatctttgtgtatgtataagggttacaacatcaccattgaggtcgaaaaatcatttcctaataaagtcatgggagacgaaagaagattttttcaagttttgcttcatataattggaaatcttttgaatggcatccacggaggacatcttaccttcaaagttctctcagcaagtgaaaacgatgttagttggaaaacaccgagatcaaactcatccaatgacattgtctatatcaagttcgagatttgcacaaaatttaatcgatctcagtcagagatcacccctgctcctccaacatacgacactgaggagattgaggagagtttaagctttgctgtttgcaggaagttggttcatgtaagctttttattttcgtgttttttagtacttcttgaattttatatccttatcttagttagctatatcaattttatgtccttatctggtgtgtgaaaaatgttgaaacagttgatgcaaggagacatctttataatccgaaatttagcagattttgatcaaggcatggctgtgattgtcggattccaaaggcagccgttaattcccttaggcatgtccgaatatgtggagtcttctaatcccacatatccacatcctgttttacgtggtgtggaggttctgttagctgactatgatgattcgaatagagctgtaacaaagaagatgctcgagaaattgggatgcatcgttactttagtttcatctggatatgaatgcctcggtgctgttggccccgttgtgtcctcgttacaaattatacttttggatcttcatctgcctgatttagatggctttgaagttaccatgagacttcgaaagcatagaagacagacctggcctttgatcatcggtttagctgcaattactgatgaagatatcagaaaatgcctcaagatcggaatgaatggtatcatctgtaaaccattgctcttatcaggactcgccgatgagcttcagaaggttctgcttcatgcaaacagaggaatgccatgacggtaacgtttacaatagactatagtaagtgaggaagtctttttaaggtacaaatatggtagatgtaaaaatagaaaaaatataaaaaaaagcttcagctttacttatgttaagtacacaccttgactgttaaatagtatatagatacttttatcttctttatgttcatagaaaatcttaggggtttacatcaatttgctactactaattgcggtaaagttgtctccgtttgacctataagtcacaggttcgagctgtgaaaacagtcactaatgcttgcctaaggtctacatcacactccttggggtgtgacctggccttttccgaggtttgagccgtgaaaacagttactaatgcttgcctacagtctacatcacacaccccttagggtgcgacttggcctttcccgaggttctagtttagtacatcacacctcttccgatgcaacctggcctttctcgaggttcgaaccgtgaaaacagtcttacctacgatttacatgggcccaatccgacctttcctggaccatgttacggcgagatgctttgtgcattgagctacgtttatttttgttttgtgtggtttattttggataaccttcttattctggcttcatatattatttaattaatgttctgcttgatcctagtgatcatataatataatatagatatagatatatatatcctacaatattctctgcaataataattgaccatatccagatatattttcttcattcagacaaaccaaaccaattttcaactcaccttcacccatggcacgtgcattgcatgtgctcccattcctaatatgtgtttactgaagtgactaaactatttcgcgatcattttattaaatcgtatatatttacatttctatgtataaaagcggagacagatattgtttcaaagagtttatctgattttccttcgttagaaagttatgcatagcatatatataaagttaatttccattttttttagttttgtatatttaatatgaagataatgaatttagctgaccagacaaaatcgctcggaaaagacatgagtagtgggaagggtatgtggagaataaataggtcaaagatgcaatcatattataccctttctatttacatacatttttttta

SEQ ID NO: 468 - DNA, 3619 bp, Solanum lycopersicum
acttcacaattccagcagctaagttggcaaaaagtgaaaccactaatcaactaatagacaaaaataaaataaaataaaaactagtactattattatgctcaaagttttgggcaaaaacatgatatgctttaagacaaagagaattttgtagcataatgagatgagactgttattattattttcgtacctactttcaattaattatgcaacgtaacaacaattttcaaacacaagcaacttaggtaaatatggttcattttaggctcataatatgatctctctgtaccacctaattgtaataattttacagtcttaatatttatattatatattttttttcacatgagtattttagataactttcaaatgaattttttttttctcttctgcattcaaatacatattactgaaattttagctaattttaacacgtattcaattttgtatgattgaatgtagacataatggaaaaattgaaagggtgttaaataagtttattaattataaaacatttgtatttcaaatttagttaaatagtgggagcggaaaattcgggagtaattaatgaaaatgtgttaaaaagtgtcagtagattgacggaattaaagataaaaagcggctgcaagtgttccatgggaaacctttaatgtgatttggaacttttttttttctttctttttttaatcccattccattccaatcaaatcaaattaaaacaaaaccaaaagattcagtattatgattgcttcattcataatcagagattttatatttgagttttgaattttgtttttgaaagttctactttcgaatgagcattgcagtatgcgattcatatttagttgaacctcaaatgcgagtgaaatttgaaaatacaaacacaacgcatctaaacacacatttaagacatctaaaatcaatagactgtaccaacctattatgtcaatagtgttcaaaatatgttatttaatcactttgtatattcaatatttttttccgacgattggacacctaaaaataagacaaaacaaaaaacaaaataaatattatttctttttatgtttttgttcccgccaatatgtcctttgattaaggaggaccaaacttaggtatacacacataatttctctgttataagtagtgcttctcgttgcatcattttcttcaacaacctcaactccattaaatcttaagaatgggtatcataattttcatccttgttcttctttttgtagactcatgtttcaacattgttgaaggaagaatccctggtgtttactctggtggttcatgggaaactgcacatgctacattttacggcggaagtgatgcttctggaacaatgggcggtgcgtgtggttatggaaatttatacagccaaggatacggagttaacacagcagcactgagtactgctttgtttaacaatggattaagttgtggagcctgttttgaacttaaatgtacaaatactcctaattggaaatggtgtcttcctggaaacccttccattttaatcacagctaccaatttctgcccaccaaattacgcgttgccaaatgacaatggtggctggtgtaaccctcctcgccctcactttgacctcgctatgcctatgtttctcaaacttgctcagtaccgcgctggcattgttcctgtaacttatcgcaggtaataaatcaattaattaaatattgttaaaaaatgacaaaaattcttataatagttggacaatccttctctctttgagctagcttttagggtgtgaattaggtctaagatctaatttcacgtggtatcgtctcacccgatgctgacgttcccaaaattaaaattgcccacgcaccagatgctaaccactggtcgtgaggtagggtattaaaaaatgacaaaagttcacatcgatgattaatgagatgggtagacttcttacaaggcttgggcaatcttcctccgtttgagctaacttttggaaataatttcaatagtaacgtgtatttgtgaaatgttcaggatcccatgccgaaagcaaggaggaatcagatttaccatcaatggattccgttacttcaacttagtgttgatcacgaatgtagcaggtgcaggggatattattaaggtttgggtaaaaggaacaaagacaaattggattccattgagccgtaattggggacaaaattggcaatcaaatgcggttttaactggtcaatcactctctttcagagttaaagctagtgaccatcgatcttctacctcatggaatatggttccttctcattggcaatttggccaaactttcatcggaaagaatttcaaaatataaaattagtaagggtattgttatttttaatttgtgggaaaactaggatatttcagagtgttgttcaccttaggaaaagaaatcgagtcctcactgaaaattcagatagataattaattaaattactaaaatttttcgatatttttgagtgtgtatcaacattttaacctaagtatggttaaatggagagaaaggttgaagtggctgcaaaatcatgcagcccgcagctgtttttttttttttacaatatacatcacaagtttttataaatgcattgtcattctgttcaatcttttttaccttatttccttttactagtttatcatacctgttttgtaggtgtgttgcaacaattaataaaattatatataaatataagaatgatatttattaaataactataattgacgttaaaataaatattgtatttatattaataattaaaataaatattgtactcaattatgttgttattattaaataaattttttaataattaagacttcaaatcagatattaaagaatattagttgaattagttcttacatcttattattacaaataagtaaactactataactctaattacttcgaagtcaattgaacaaaattgtgatttattattttctcgaataatcatggtttaattattattttatatatatatgtcttcaaaattaattaaaactatatctattatatttttacttctttgtaagacacaagaacttctaatatttagtattttaaaatttcaagatcaattgcaacttcattttcaaaatctattttacacttgtgataaaataagaatatgttgagatccaaaaaacttatttcgtgatgacagctaacagaaccaacgatattgggcctaggaagcggaagaaataagagagggagggagggagagagagcaaagatagagggagagaaagagagcaaagatactaaggcaaacgacgaaagcaataaagttatctaataactagttggatccccgtaaactcgagaaaattaccaaacgaccccctaatctattagccatttcttaactacacactaatattttatagaagtcctattactcccctaaaccttttatttttggtactttgtagcccttaaacgttaatcttttttcattaaccaaatatatgcacatgttggtatacacgcgcatggcgtgtagtgtgtagtattgaatccaacgttgtagaagcggcgttgccaaaatggtaaaaagggtcggatgaacgatataattgtgtatgcatttattttataattgtcttgtaa

SEQ ID NO: 469 - DNA, 3938 bp, Solanum lycopersicum
ttctacttggagaccaagtaagattttccccattttccttcattgtaaataagatttgtgaaaaatctatgaatcctgaatatatttcaagagaaataaaaagtcttttctctttctccctactttcttctcttctaaatttatagaattttatagcaatatacatgttttttgttttagttaggcaacgctggttggtaatagtcacgtgatttgtcctaactcctaactaacattccatttcattcaccctccgtttaatagttgaaaaggtgaatttttcatattaaacaattatcgtgtgatgtaaagaaaatattgttagcaattggtggtaacattattatagtggaaaaacaatttcttcgttgcgattatttttcttcaagaaaaaaaaacaaattacttagtaggaactacttttcaacaaagcaactacgcttttcccctaaaatagtactagtacttaattttttttaacccgtcccaataaaaataacacatttttatattaagtaaactcataataaactgatattaaaactcataataaactgatatacaactacataaatatttatcacttattttatttcataaatcttaaaaaaataattctattttaaatcgtgtcaaattaaactaacttacacatatatcatataaaataaaatgggtgtaaaatggaacagaatacaagagtacataagtacctttttacgaagttaaacaatattcattttgagtgttacactttacatttttaatgtattttacaagaaataaaaataagataatcaatatcaaaataaatatttaacataattttcaaaccaagtatggtggtacctaccctacaattggtaagcaaaatacaattctagaaagagaacacgtgaaatgttgttagttggcacgaagggtagtaatagctccacgcaaacactcccttaaaaatctccaccccttatttcaccttactacttaccgttctctcaacatttaaaaagggcacctcataactcttttgaacaaaacaaaaaatggcaccttcaacactaacagctttagctaatgaaaagacccttgaaacaagttttattagggatgaagaagaacgtccaaaagttgcttacaataaatttagtgacgaaattccagtaatatcgttgcaaggtattgatgatgttaatggaagaagaagtgaaatatgtgagagaatcgtaaatgcttgtgaagattggggtgtttttcaggtaattgatcatggggttgatgctcaattaatatcacaaatgacaaaattagcgaaggaatttttcgaattgcctcctgaggaaaagcttcggtttgacatgtctggtggcaagaaaggtggcttcattgtctcaagccacttacaggtaacaattatttcaccgcaacttattttttattttgatttataggaataaatagaaaaaaagttagtgataaatttctaaatacagaaaagatatacctacggatgaaaaagtgtttgtaacagatcccctttttttccgaggtagccgttgtatcgatagtttgaaaaatataaagtttgttttaattgttatttaaattctatgatattgtatatgtagatgaaaaaaaaatatttttttaacgacaatttgataggatcatgttattattttagtattttcagttaattttgtctttatttattattgagttattttattttatctatttacaccatttttattagtagctcatcatagcagtggcggattaccggggtcaacctgacctccaggcgggaaattatagggttgaaattattttttaggtagatgtatatagttaatgtcaaatttcttcagctacttcgtgtatctattgaacctcttatttaaaattggctccaccattatttcgtactttactttttcttgtagattcattattcaaaatatgggtgtataacgatataatataatttatcaatttactataacactacaattgttttgtagggtgaagtggttcaagactggcgtgaaatagtgacttacttttcataccccattcgagctagagactattctagatggccagacaaaccacaaggctggataggtgtaactgagcaatacagtgaaaagttgatggatttggcttgcaaattattagaagtactatcagaggcaatgggcttagagaaagaggctttaaccaaggcatgtgtcgatatggaccaaaaagtagttgtgaatttttacccaaagtgtccagagcctgaccttactcttgggctcaaacgacacaccgatccaggaaccattaccttattgttacaagaccaagttggtgggcttcaagccactaaagataatggcaaaacatggatcactgttcagcccgttgaaggtgcttttgtggttaatcttggcgatcacggtcatgtaagttggtactacatattccgataaaattaaaattatgtgaatttaattatgtgaattttggacagtatttgagcaatggaaggttcaagaatgctgatcatcaagcagtggtgaattcgaatagcagtagattatcgatagccacattccagaatccagcaccagatgcaaaagtgtatccgttaaaaattagagaaggagagaagtcaataatggatgagccgattacatttgcagaaatgtacaggaggaaaatgagtaaggatcttgagctagctaggctgaagaaactggccaaggaagagaagatacaaactgaagaggccaagttggagtccaagcccattgaggaaattcttgcttaagtgttttaacacttgaaacaacaagctatgcgcgtaatttcttttatcagtattgtcttgaataacaatcaatcatgttcttgtgaattggtgatgtttttaatcttattacaaaacaaacttagtgttcctttattcaaattaaagtcttttagatgatgcataacgccatttcctacggaggaaggtaaaattataaaattggatatacataaaactatactcgtagatccataagacttatatctcgcctcgtattgtataaaatgtctcgtatcatgtctccttttaaaacaccggaagatgctatattattagcccaagtttactagcccagctgctcaattacaagctgctcttagcccaattttccgagtatagaatggctatcgtttaattttttattttcttgacatatgaaaaagtggtatgacaagacttaagagttgacttacattagttgttccgtgtgaataataaaaaaagtgaaaatggcggaaaagatcaaatatgtcgtccgttacgtattttaatagcaagttgcatcacttttttcttaaacttggaaaaacgctttataatgtatatcgatgatagagagatatttaaatggtaaatattttttatttttaatttgaaaattgcgagtttaagtcacaaagaagataaaacgaaaggagtaaaaactcctaaaaagtgttaaaaactatgtattttaaaaaaacttgatgcggtatctctaaaaaaaaaaatttaaaccaggaggaaagtggagtgaagtatttatctttcttttttaataaactatcaaggaaaaaaaaagagatctgacttatttcttgacgtatatacgtatgagctactaccactttgtaattgacaagaaaagaattaaaaacaagtataatgatgtggaaaacattaaagtaatcgagtcattttaaagataatcaaatataaataaacattcattttataacataagaataagcattaatttaataaatacaaatgaaaagtatcatgcataaccagttaatctacataaaaattgttttatattattcgtgaatatatatgccagctcgtttacaacagaaatctgttagttatctctgaa

SEQ ID NO: 470 - DNA, 4001 bp, Solanum lycopersicum
  modified_base (826)..(845): a, c, t, g, unknown or other
  modified_base (3888)..(4001): a, c, t, g, unknown or other
acggagctaaaggcaaattagaagagggaattattcatttgatgagtaggctttttatttgtggttactattattaggaatataagaatatatgataaagtacgtagagaacgtggctcttacttttcaaagaataagatatcttatttctcctcgtgacactaataagtgtatttgagaaaaaagaaatttgaaattgtgattgaaaatataatttctcaatgtggaatttaattataattttaaaaaattgcctgattttttttatcaaacttgttatatggatcttatttaatacaatttattttatcgtaatgacgatgattgatttcattcaaagaggaataaatttggatgctttatttatctaacataggaaggtttactgtctcaaatgtcagaacaaagctaaacaaaaatattacttttggaataatattattttattaaaagcacaaaatatttcttggacttagctcaatataataattatactttgaaaatattattatttttattactaaaagcacacaacaactaacatatatttgagaaagaattccaaggtcatttgctcacaaatatatatgccttctgtaattccctaccaatagaagaattggaaaatttttaactaaactaagtcattataaaataatttatcaaagtaatatatttttttaaaattttacaaaactagtataaacgtattccacggtaacgttttagggtatgttttattttttaaaaactaacagcattactgtgagtaacgttttaggagtaaaacgttactgtgagtaacgtatatcaatctgacgccatnnnnnnnnnnnnnnnnnnnncatattattttggtgaatgactttatataatgggttagtttggttaaaacctgaaattggacaactataaatagccatagccctttctcccaacacacaaacaaacaaactttaattaattctccaaaaactttttaattatttacaacaacataatggttctctcaaaaactccttctgatgattctgtacactccacatttgcttctcgctatgttcgaacttcactaccaaggtaaacaatacgtgcatgttataaataataataggttgaattaacactcatttgattatttgatattctataggtttgagatgctagagaagtctataccaaaagaggcagcataccaaatgattaatgatgagttaatgcttgatgggaatccaaggttaaatttggcatcatttgtaaccacatggatggaaccagaatgtgataagcttatgatggcttcaattaacaagaattatgttgacatggatgaataccctgtcaccactgagcttcaggtgtgtgtatttggatatatatgattagttattttacatatatatatatatatttaattgattggtaatgaaaatacagaatcgatgtgtaaacatgatagcgcgtttattcaatgcgcctttgaaagaggaagaaataggaattggtgtggggacagtggggtcatcagaggccataatgttagcagggctggccttcaagaggaactggcaaaacaaacgcaaagctgagggaaagccttatgataagcccaacattgtcactggtgctaatgttcaggtattttacatgtcacatttttttttattttattttattttatgtatgcatacataatttcactttctttcttttaggtgtgttgggagaaatttgcaaactactttgaagtggaattgaaacaagtcaagttaagtgaagggtactatgtgatggacccaatcaaagctgtggaaatggtagatgacaacactatttgtgttgctgctattttgggttcaacacttaatggagaatttgaagatgtcaaactcttgaatgatcttttgattgaaaagaataaacaaactgggtatgttaatatattttattaatacatatatatatgttggttaaaataaataatattttcttatttttgtttttgtcagatgggacacacctattcatgtggatgcagcaagtggtggattcattgcaccatttatctatccagagttggaatgggattttaggcttcctttagtgaaaagtattaatgtgagtggacacaaatatgggcttgtttatgctggtattggttgggttatttggagaactaaacaagacttgcctcaacaactcatttttcatatcaattatcttggtgctgatcagcctacttttactctcaatttctctaaaggtcctatcctatatactctaatttttaattttatatttatattattttttttcttcaaccctcaatggtatacataaatttgtaggttcaagtcaagtcattgctcaatattatcagcttatccgcttgggctatgaggtaaaattaatcatacattactaaaatgaacaaacaaaattttgtgattcataaatacattatttttttttatatagggatatcgaaatgtaatggaaaattgtcgtgaaaatgcaattgtgctaagaaaaggacttgaaaaaacaggacgtttcaatataatctccaaagatgaaggtatacccttggtggcattttccctcaaagacaatagcctccacaacgaattcgaggtctctgagaccctccgtaggtttgggtggattgtcccagcctacactatgccagctgacctgcaacatgttacagtgttgcgcgttgtgattagagaggacttctcccgaaccctagcagatcgtcttgtctctgacatcgtcaaggtcctccacgagctcccgaatgccaaaaaagtggaggataatttgatgatcaataatgagaagaaaacagaaattgaagttcaaagggcaattgctgagttttggaagaaatatgttttagctaggaaagcatctatttgttagggaaggattaatggttgttttgaaggaataagtattaattactagtaacgttttggtattaattataaaaaatgtgaaaagaattgatgaatgtatcatcctttgttctattgaattgaatattatattatgttacatctctttgtattattatgtcttgtactgacttttgttaatttatttaattatatttatttttagtttgtacaaataataattggtattctctgtgttcttttttatttgtcaacataatagctgacctatatcatatattatcattttttttgtacgattaattttttaattttaaaacattgaattaatctattttaatttaatttgatatttattaataaaattatgagcaacttttacatatagcaagcacaaaattcatttttgtatgatatagaaaagattgcataattgcgcttcatagcaaacataaatatatataattcgttatacatatataaaagaaaatagttgtatactaaacaattgtataatttgtgtatgcataaaacgagaaagagagagagacaaaagaaaattgaggaagggaatatttgtattgtataatgataagtgtgtaggatgaagatatatgtacttgtaagtgtatatacaattttctctcactttatataaacagaaacgcaatttatacattttatttttgtttgtataagcgatagaggcgagagtggcgagcgagattggaaaattcattttttcttgaatttgagtgatagaagaaaagaagattgaagcgtatggaaatggaacaactaaaaaatatctttttgaggcccaaatggtaaacataaaaaagtccaataagaagggatttgggctattttgattattttttgtggtctttaatttttgggcaactttcacatatagcaaacaaaaaattcatatttgtatgctataccaagctttgcataattgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 471 - DNA, 3563 bp, Solanum lycopersicum
acaactatttaccagattgactcgtaaataaaatatattatttgccacataatgttaaaaatatattgatgttgtagaatatgttaatatttatagtataagttaaattcatctatcgatcgtaagtatacagagaattcagtaaaacgctatatcaacttcctagtcaagcaaagatatggatacttgttgataaatcatattcttgcaagcattaccactttctcaaaatatattctcttaatatattctttttggaaatcaaacaaaatgaagtggacttaaattagttcgtgattttgttataaataatagaacataaacattagtttttatgattttgttataatatcactttcttcatttctcttccattgcctcggcctcatgatccttccagaatctttttttcttcaatatatacacacacacattgattgtacatgtggaaaaaataatattgttacactattgatatagttaacacgttaaatcatcaaataactaattaatttcctttacaatagaccacgatttttaattaatttttacatgacctcatattgtaaaaaataatttacactttgattgtataaaaaataaaactcttccaaaatttgagagaagagtgataattaagtgtaaattatttttatttaagaattataatcatctaatatccaaaatcggaagtgtttctcacttgttgacacatttatactgggattacacattggtttggttggggtcaaatgtcaacctatgacaagcgagaaacagacaattcattattcgttaccaatattattcttttttctacctattcatccctttgattattgctattttctcctttttaaatttatctgatataattataattaattaaaaaataaattaaaaatatttttatatatttcttaaatatttaaattgttaatcattatacattaaattaaaattcaccgtctaaaattaaaagtttgaatctaaatatttcaatgatagggaaagcaaataagcaatagtacctagtactatatagtataaattatagtgctccattttaacccaccaggcaagaaaaacgtcttctcttcaatttcagtttctttatttctctatttcaaccagaatatcaagtacaatttctctcttttcattttatagatttcaacaaaactcagaattactactaattatatttgatttctcgctgatcatggagagtatatatgacagtgccggtcttgatttaggattaggttattcatcaacggtgaatcagacatcaagaaaagacggacaagtagctgcagttaaatccgatctcggttttgagccctctctgaatttaagcctttcttccggtgatcatcagatggtagatctgaagacggaaaataaggatcaattatctgttgcttcgtcgtattcaaatggcagtgtgaaaagggaaagagatattggtagtgaggtaacagaagtagaaagagtaatttcttgtagagtaagtcatgatgaagattattatgaagatgatgatgcttcaaatggaaagaagaaacttaggctcaccaaagtacaatctgctctgttagaagaaagcttcaagcaacagagcactctcaatcttgtaagctatcaatcttttctggcgtgatcatttcatttaaaagttttaattattttttgatgagtcgagattgtgaaaatcaagagtgatcatcaaaatttctacctgagactctgataccgtatgaaagttgtgagttgtgactatatcttatattttctctgtctcaatttatgtaatcctacccaaatttgatttgatttgtatagatataggattttctaaatgacagaactgatgattcacatttcgaataattcagaagcaaaaacagaacttggcaaggaagcttaacgtaaggcctcgtcaagttgaagtttggttccagaatagaagagcaaggtttgacatctttctcgtatatttaatagatttcttaatataaatacgttaaataactaacaaaataaattagacatcgaatttaattagatatttatcgttttcacagaacgaagttgaagcaaacagaggtggattgcgagtttttaaagaaatattgtgagacactaacagatgaaaacaaaaagctttacaaagaattgcaagaactgaaagctttaaaagttgggcagccgttgtacatgaagctgccggctgcagccacgctcactgtgtgtccttcctgcgaaagagtcggcgccggcgctgcccaaaactcagccaagcctcctcacctatacggctcctttactaatccctcagcagcttgttaattaattagtacagtatgcaaatcgtcttgttgaatttatttttaattaatgtcttgttgattaactagattcttaggaaatctcccaaaacttattaagatttttattttttttaatttgtactataatgaaatgacttgtatagttcatttgttaattagagatttcctaatcattaatcaatattctatttactcatttgtttctttaatttgtcgcagtgcagctatgtaaattgttaagaaatatatttatttttggtaatctatgtttcttcatctcctgatcattttcaaattacttagagatattattttgagtttagcttaatatatactgagatttgtaaagaactttagattatcaattcaataaacaggggatgcgtgttgatttccaaaaattcaataatttttttcgaaattctataattacatcgataattcttttaatgacatcaacatataaagacgggaaccattaacaaccggaaggataatcacatttgtatattctagaaaacctttattagaaccgtaaaatcaaaattctaaagataataaaaaacagattatcgagtatatatatttaaaaattaggtaggtgttgcctgttgtgttggtccatttaaatgtaattatactaaaaagttggtctatatactattaaatctcaatgtatacatttccacgttttgttgcgtcattggatgtaaatttattttcttctaatttatgtgggtgttttttttttgtttaaaaacatttattaatcatatgatcaatagaaacaatgtctatgattttattttgattcataaattttaagagtttctctaaaaaaatttaaattatgaatcaattaaataatattatataaattaaaatagaaaaaataatacaaacaatatgcatgatctagttgttctctctctataatatatttactccatttcacaaagaatgacatgatttgacttgacatggagtttaagaatataaaaaagatttctgaattttgtggtcctaaattaaagtaaggtcaaatatattaaaaaattacactttaatcttatggccttaaacatggcacgtggaaaattgaaattaaaatattataaaaaaatcattctttttaaatagattaaaaaaagattattctttttgaaacggaagaagcatatggaaaaggagattataaagtagtgttgt

SEQ ID NO: 472 - DNA, 7062 bp, Solanum lycopersicum
tcaaagtggatttgtccctaatgattaaaagaacagataatagatctggtatttttccatgtacctttagaaaaaaattctcttttttattttattattctcaagtttaagaccaaataactaccaacattacattagcacaataacaataataatgtttgtagtatagtcttgtgcttataaaaaaattgaaaagaatagactacaaataaattttatacttatttttatgaaataaatattcaattcaatccacttcaaaatctatgtaatatgtgaatttgttaagaaaaaacttttttcattttttaaaaaaatatacggcattaaaataatatcaaataagcttttagcgttaactaacatttatgtagggataaaaaatcataccaccatttaattctatcaaatcatatgtttatcataattaagttatatattcaaagaaaaatgtgttttttgtttttggtagataatgcattatcgataggtattgataagtgcttctataattaagtaaacattaatctatagttaagaaaatataaataaaatatattaattttctcataactttttttccctatctacttatcaaacatcataagttttttataaaaaattatatataaatatcatatttcttatccttatattaaactaatcttcattttattttataactccatacattctaatttacatgatatttttctaaatttgagatataaacaaatctatttttaatcgtaatttttttaaatatttttttaaattgttaattattatgactttcttttagtattttttatatacattttaatatataaatttatcatttaaataattaaaaatttcacataaatttttttaattaaatttaaattgtttcactctcgaaaaataaaaatattgatataattttcctccatacgatcacatgtatacatgtctgccgaactatttatttatttatttattttcttcataagtctgcggaatatcaaaatggaaaatttcttaacagtctccactctccagttttgtataaatatgtgaaagcctgctaagcataaaccatcactcgcctttctctctcttctgcaaaacgaaaaaaaaaaagtgtgtgttcgccggcgcttaattcgaggagatttagagcgagagaaaacgttgtgttcgccggcgtttattccgatctgttcagtttaacagaagaagaaagtaagtgtttgtgtgtgtttttccggcggttatttcgattttttcaagtttaacactgtttagtaaataatcggacggagagaagaaatcggaaatcggagaatggcagctcaaccgaagaatgtcggaattctcgccgtcgagatttactttcctcctacttgcctacagcaggtactttctctcttttatctcacatacacatacacttgtgaaactaacggcgtgtttggttaagtttttaagagattggaattcgaaaatgattatttgagatgtttagtgtttagtcaatttttttttttgcagaaaataactgaaagttgttttcaagcttaaaaaaaataaatccgatagtacttttttggaaaaaaattaaattagaaatagtttagaattgtttttcccaattgattattcaaacacaatatttttcacttaacaaaaatagtataaacttatttttagaaattttgccaaacaggctataaactttgatcatagatattaagtgctttaaattggttgaggaattgaaaggtggaaagagtgaaggagatcgacttactcttggcgcgtggttgaaatttgggaaattttaatttttgtcactttcttatacggatttttttttattgtctttttctcgaaaacaaaataagtagaatattttttttttcattttgttttatttctggtaaaatattccttaaatgtttttttttttcatttttaatcttttttaaagttcaaattcccttaattgtttcatctagaaattcatagagaactccgtctaatgcttcatatataagcatgtagtgaatttatgtgtatcgtttgatctaatataaagttttaaaaaaatgaaagactttttaatttgtggtgataaattttagatgcatgtgtgattataaatcattcaattcagagtaaaaaaacagtaaaaattaagttattgctaattatgaaaaatgtttttttttgggacagactaaaaagaaaaaaaagtcatgtaaattgaaacagaagacataatcacataattgtattactatttgaggagtcaaatgatggtagaaataattttaattattaataattgtgactcgtaatcacataattgtattactatttgaggagtcaaataatttatgtcgtatcgtttgatttaatacaagtttttaaaaaatgaaagactttttaatttgtagtgacaaatcttagatgtatgtgtgattataaatcattcaattcagaataaaaagatagtaataattaagttattgctaattatgaaaatgattttttttgcgacagactaaaaagaaaaaaaagtcatgtaaattgaaacagaagatataatcacataattgtattactatttgaggagtcaaatgatggtagaaataattttaattattaataattgtgattcgtagtactttcaattatattatatatatataaataataagtgcaagtttaaggcagttaaattctgatcacttgcaaaaaaaaggaagaaaaaatcattttattttgcattatataggaagcattggaggctcatgatggagcaagcaaagggaaatacacaattggtcttggacaagattgtatgggcttttgcactgaggtggaagatgttatatcaatgaggtatgtcgtctccgttggaaaataacattgcataaattggtcatatttttctttttatattgataaacacttcttcgcgtgtttagttctttatattctgaagtatgtaaggtgttagtagtttcttctgctagatgaacagagtgataaatttatcattgtaatttttgtcactatactgtcttctaattaaattgttcatgctcagtttgacagcagttacttcccttttggagaagtatgctattgatccaaagcaaattggtcgtctagaggttggaagtgaaaccgtaattgataagagcaaatccatcaagacattcctgatgcaaatatttgaggtacacagttctagcaatgcttgtttagtaaatcatctatcatggcaagttcaatgaatcaaatgtgttttatgacttgtatcctagacgtctggcatattaagcaaaccgattgatcgaccaaaatgaaagtagatagttccagatttactcactacacgctatctcaagaggatgaatatatcttgcagccaagtattaggacagagatttcaaatgttggaaccacttaattctgcctgaaatatgttgtaatgttagctttatggccctaaatgcacttgctcatccggtttgttgaaaaaagtgagtttattgtttgttgtacatcatcctgaaacattggttggtgcatctgttttgtcttacaatgatatgaaatgagcttaaatgaagaagtggggattcatatacccgcataacttgtttgaggcttgagatgtagttattcttattgttgaatgtgatttatttttgcctcacttgacattccacttcacaagcagagctttacattataactaacaggaattttgttcaatgaaaacttatcctgcttccttactgtgtcaaacaaacagaaatctggaaatactgacattgaaggagtcgactcaactaatgcatgctatgggggaactgccgcattgttcaactgtgtgaattgggtcgaaagctcttcatgggatggtcgctacggactcgttgtgtgcactgatagtgcggtaagctcatcacattcataggatttctacagcatgtgtgttgtcttttaaaatatcaagtttgcattgctcatttggtacatatttgtgatgaatttgagcatctgcatgatagacattcactaatttcaggagcttattttgacaggtctatgctgagggagctgctcggcctactggaggtgcagcagcaattgctatgctagtcgggccagatgctcctattgtgttcgaaagcaagattagggctagccatatggcccatgtctatgatttttacaagcccatactcgacagtgaatatccagtaattcacttacgcccatgcaatcgttaatcgtccgtttttacactggagtgttttttatatgttgtttacttcataaaattttaaaaatatgtaggaaattgtttgagattggtatatgaatttccatatgtgttctatatgatggtatattggtaattaattgttggtttgcaggtggttgatggcaaactttcacaaacttgttatcttatggcacttgactcttgctacaagagcttatgcaacaagtaagctgccggttgagcacacattctagtattccaaacaaacctctatattatagtctttaataacctcttcgttcacattctagatacgaaaaattggagggcaagcagttttcaattgatgatgcagcctattttgttttccattcaccatacaacaaggtactttatggatccaatacagaattttgatcttttttctttgcaagtaaaatgatgataaagattacctgaacatttattttatttaatcctgcagcttgtacagaagagcactgctcggttgatgttcaatgactttacaaggaacgctaggtgtgttgcaaatattccgtactaaagcaattgcttcctatcttgtaaatggaattcagttgactgatcttattcgatattgcatttgcagttccattgatgagtctactaaagaaaagttggcaccattttcatccctaactggtgatgagagttatcaaagccgtgatcttgagaaggtccatacataagctttcatattcgttgatttccaagaaatattgtcttttttcattttcattttcaaatggcttcgtgttgatcttctagtatatgtttagaatgctgaaaatgaagctttcagtagtaagaattgccttaacaattatatatgttgagattggaattaactagtgcattatatctattggcatatacagacatcctggcaagtagcaaaaccattttatgacgagaaggtaaaaccggccacattaataccaaaacaagttggcaacatgtacaccgcgtctctctatgctgcttttgcatccctccttcacaataagcacagctcattggtaactacaagctacttcttttccttttggcctgttttctagcaatactctatcgtgtttattataatttcaaatgattttgtcaactcaggctggacagagggtagtattgttctcttacgggagtggattgactgcaacaatgttctcattaaagcttcacgaaggtcaacatccttttaacttgtcaaacatcgcaactgtgatgaacattgaagagaaactgaagtcgaggcatgaggtatgataaaatcgtctttatgatttactcacggacattgaacccgttgccaacactatgacagttgagtaccataactctctttgacaaacaatcttttgtgcagttcactcctgaaaatttcatcgaaactatgaagataatggagcacaggtacgggggtaaggactttgtgacgagcaaggattgcagccttctagctcctggtacgtactatctaacagaagtcgattcgaagtacagaagattctatgcaaagaaatgtgctgagaatggacttgccaatggtcattgaatataagtcctagtatgatataacttccatgaattttgcttgtactcttttaattatataattgcttcataataacatatagtttctttctacttcccaacaaattcaatatttgtttcttgtattctcatcaatgtgtagtcttatatatgaattgagaaaaactatattttgagatcggctatatgaatcatttgttcttacatagtatcaactattacaagatcaaatcgcaaaataaaactcgagaaataatattgagaaaaaaaaatcaagaataattgcttgtgaagtccaaaaaaaaaacataggactacatgatgattatttgaagttgacattggcttgataagtcattcctacttgccaactagaaggtgcaacattagtagctataattgtttcatgagatgtgtaagaagtgatcttaaaagaaagtgtttgtccacttagagttgcaaatgcttgatatgaagctccccaattatggctcatagctaaccaacttgttttacttcccttcacccacatacttgcaatatctccacttccaccaacattcatcacatataccaataaccaatacccatttccttgaagactaaactttattccaccttttttaacacaaggtaccctacaatcatgagagcaatggtacatgttagagctagtaaaaatagtcgaggtgcacacaactgattcttgattttactcaaagaattagcgctaaaaagttagtttttgcagcatctaagttaagtaacacatcaaagccctagaaatggaagaaaatcctgatatggagcactccggtcaaacgttctctccactaaagacgacattatttatagggatcgaacgtgagacctccggttagaggagtacttacaattccaccacaacctttgacagtctctaaaatattaaagagataaaacataaatagacactcaaacttgacctcagtaagcactcaaactttgaaaacatgcatctaaacacctcaattttgtctcaactgagaactaaacagtctaactcattcccactatgtataatggacacccacgatgacacataaattttagaagtgtctaaattatatcattatgtaagttggaattttcaactgaaagagtggagacgagttgagatatgcatattccaaactaag

SEQ ID NO: 473 - DNA, 5479 bp, Solanum lycopersicum
ttttcatttatttatactttcatcgatatagtaatatttaagtaatgaacaatcgtttgagccttactaaagtgaaaatttctgttcatgcaaattttgtcgagcttctataatggatacttgttaattaccatctaaacaacctttttgcaaatgtcatgattcacaaatttaattcaacgagctcaacgttctaaaatatttttaaaaaccttttatttatgatattttaaagatgcaacgctcacggtacgttcatgttagaaaacaacgaatacaattaaatccatatttaacactatcctttcatgtgcgaccaaatgctaaatgataaaattaataaacaaacatgctcaatcaaaaaccgcaaattaagtccactttccactatcttaataatacacttttaaaatcctaaatctactgggagatcctaaattaattcgtttagctaggataaagattcttgtataattatacatgttcacctcttgaataaatgttgaagtgatatcaagaactttatctgctctaatattatattaaaatatgcggttatctcatcttaaaatttaagttataaaagacaacacactgtactacatttagtacaggtgctatgtattttcattataattctctatcgttaattcaattacagctaaatatttttataccactaaaaaaataaatctatctatcatcgaatatatatcttgggtagtgataatacatcgagtcaattatgtgttaagcatttaaaataaagttctaataatgctgagataagattctacgcatagttttgacagctaaataaaaaaaacattaattcaaaaaaataaaaaattgtgacagctaaggtttacaacattgtaatagcctccttcactttctatatatactctttatttcccacatcttctcctctatattccttctctttcattatcaaatttattttcaaaaaatcataattttttctacttaactttgttctgtgatcagctcggaaaaatggccggtggtggtggtattggtcccggcaacgggaaagaatatcccggcgagttaactctttatgttactatgacttgcattgttgctgccatgggtggtctcatttttggttatgatattggaatttccggtacgtgaccagataataaatttaacttatatacatcgatcgattgatcgacagtatactgataatttttaatttttttttatgttatggatcagggggtgtgacatcaatggacacatttttgaatagattttttccatctgtgtatagaaagcaaaaagcagataattcaactaatcagtactgtaaatttgacagccaaacactgactatgtttacatcgtcgttgtatttggctgcccttgtgtcttctctggtggcatctactgtcaccagaaaattaggaaggagactttctatgctctctggaggtatcctattttgtgctggagctttgattaatggatttgctcagaatgttgctatgctcattattggtcgtatttttcttggttttggtattggatttgccaatcaggtgcgtctattttttttattcaatttaagttttgtgtgcttgttgtaaaaaatattcattgaacgagccttcttgtggttggcatgtggtaatattcctaattatttgtttgttggtccgcgccaatattacaataaaaataacttttagcagtaataaatattaagtgctacaatttcttttagcagcagaatcaatatcgcaaaagattttatgactttacttggctaatgatcatttttgatacagtacgtgtttatgctattgagcaacattatctatgtgtttgtctctgtttaattatttttttttctttcatttagttcaaggctgttctgttctatggttcccctgttcttttggattatgccatggaattatgtttatttgttttatttatttatttatttcttggtttttaaaaactgtaaaatataataatggcaagttgtcggtcaacacttctcctgctgtgcggatctgaatggcagcaagtacttactgaatccatatattagaccactcattaaatatatttttattttatttttcttagaaaataatctttttatattttgtaaaaaaaaaattacacttgaaatcttagtattcactaaatatcttgtatttgtccattgaataatgaaaatattttttggtttaaaagaaaaatgtgttttgaatacaacatcattgtgatttggactttcgagctcttccaagtaagaggaacctacttttttaaatattgcacgttaaccctacatgaaaagacttttttgctaaaaaaaaccccaccacgcactgtaaacagtccatatttcaccattatatatatttttttaaaaaaataattattcttcagtcctttaatttgaaaaataaatctactttgggattcttcagcaagttgtgattgtcattatcacttaatcaatatttaatccaatgaaagttgttgagattttttttttaaaaaaaaaaactcttttcctaaaacactgtttagatgtgtgtattttattttactccaatttttgtgacgttgccgtgatttcttttctacaccgttagctcatgaatacgactatttataataataaacaaattcgtataaatcataaaatttacatatttgtttttattttactttctttaattaagtattattgatatatattgtgttttttatcaactaggacaagaacaagtggccccccctcatgaagaaaatacaattcctcttacttttttttttttttaatgttaactcgataatattttagtatttgaattttgagattttaatcatgtcaagtagaatgttgaaatcaaaagagttatccgatatagaaaaaaattgttatctttttaatgggactaaaaaaagtttcagtcagatacttaaattgaactatttttgttgttgtttcattgacttgcagtctgttccactatacctatcagaaatggcaccatacaaatacagaggagcactgaacataggttttcaactttccatcaccattggtatacttgtagccaatgtgttaaactatttctttgccaaaattcattggggatggagattgagtttaggaggtgctatggtacctgcattgatcatcacaataggttcattattcctccctgaaacccctaattcgatgatcgaacgtggtaaccacgacgaagccaaagctcgattgaagagaattaggggaattgaagatgtagatgaagagttcaatgatttggttattgctagtgaagcttctaggaaaattgaacatccctggaggaacttgttgcaaaagaaatatagaccacatcttacaatggcaattatgatcccatttttccaacaacttactggaatcaacgtgattatgttttatgcacctgtgttgtttaaaaccattggttttggtactgatgcttcacttatgtctgctgtgatcactggtggaatcaatgtcattgccactattgtttctatttactatgttgataaattaggaagaagattcttgtttcttgaaggtggaattcaaatgctcttttcccaagtaagtccatttcttttttcttgcgaattcagaaaatttagagtctattttctaatttgaacttgtttttttttttgaattgatgtacagatagccgtggcaattttgatagcaataaagtttggagtaaatggaactccaggggaattaccaaaatggtatgcaatagtggttgtgatattcatttgtgtatatgttgctggattcgcttggtcatggggtcctcttggatggctcgtacctagtgaaattttcccactggaaattcgatcagctgcacaaagtatcaatgtctcagtgaacatgatcttcacatttgcagtagcacaagttttcttaacaatgttgtgtcatttgaagtttggattgtttctgtttttcgccttctttgtggtgattatgactgtgttcatatacttcttcttgcctgagacgaaaaatattccgatagaagagatggtgattgtgtggaaagaacattggttctggtctaagttcatgactgaagttgattatcctggaactaggaatggaactgctgttgaaatggctaaagggggtgctggttacaaaattgtatgactttagtttgggtttttaaatttttatttgttgtttgtataatgttgtagtggggatgatattgataattattaattagatttgattgaaactgtttctattgtttacttttgcatagaaaaaaatacataactttgttcaatagaaaatttggcaaagcaactgtgtagccttttgtttgttttgttggatgtactatttagtagttctagtcttttagtgtaagatctttattataaaaaattatgttcataagctgtgcactggatacaaatctttgatttaaatagtaatttatgtgaaattgttttattttgtgcggagggatttcttttaaaattgtgattttcaacgagttatagatatttgtgtgatcgtaaaatatgttattagagtaaagtaagattttaatttgctaaacttttacccttcttaatttgcccattgtatggtataatatgtggtctgggccagccaatgcccagttttgttcttttttactcgatctgtacagctacactttggtaaataaatgctgtactatatactttccaaaaaagaattataataatgttttttttttctggactaaataaatattataaattgggacagggagaatttacattagaaaagagatccctttcactatacacgtttgatcaaacttttagaattttttttttttaaagaaaaaatattagaagtgatttaaaataaatatttttgaaagtagtaatttgtgtttaaccaattaatttgaaaataatttttttggtccatattagataataaatctatgcagttcaatatccatttttaatacaacaacaaatcaaacaatcaattaaaaagtacatacaatatcaaaaataacttatcttcatatcaaacaaatatttattttcctaaaagttgggacaaacatttcaaccctctaaaataggcatatatattttttttcaaaataaattaaaaacaacatatttggctttagggaaacttgcctaacatgctttaaatgatactcagagaaaaaaaaagaagaaaatgaatgatatttttgtgttttgttttgtgtccttgtcctaaactttgagatgtgtaggctaattttaggaatgggacatttaccaaacacttttaattattattgttgggataaaaaacaaaaagttgcataaaaaatgaaattaaagctaagtgatactggtattttggtagctcaaatgtcaaactattttcaaagtttattactct

SEQ ID NO: 474 - DNA, 7242 bp, Solanum lycopersicum; identical to SEQ ID NO: 387

SEQ ID NO: 475 - DNA, 14147 bp, Solanum lycopersicum; identical to SEQ ID NO: 317

SEQ ID NO: 476 - DNA, 3775 bp, Solanum lycopersicum
  modified_base (1)..(79): a, c, t, g, unknown or other
nnnnnnnnnnnnnnnnnnnnnnnnnnnnnnnnnnnnnnnnnnnnnnnnnnnnnnnnnnnnnnnnnnnnnnnnnnnnnnnggtttaggattctataaatagaggcatgttccttctaacttaattagcattcacaatgtagttttaagggctttgagagttttggttagagggagaatttgtgaacctctcatgtattccgagtgaattggttgaggttgtttccctctgtattttgtactctcatgtttatagtggattgctcatttcctttgtggacgtaggtcgattgaccgaaccacgttaaatctttgtgtcttttggtatatttctcgttgtcttcttactcgtggtctttcgaggtttgctttgctagcttccgcgtttacacctgcttatttacggtcctaacagagttcgatgggttgaatctataaaaagaaaaatatactcgtgattcacgattatttatatgaaaatataataaatattgaatttcctttgctatttcttatgtttacgtctttatatttcaaattattccaccaatactgacaagccctaggccatctctaggaaattcatacaatttttttttgttgttaactagttaaattggcagccttaaagattattgtaaaattcaaggcaacttcctcaagtactacaactacattgtaacatcccagtcaaagtgtcctaaaattttataaaatttgacacatgaaacaatagcacaataaattttagtactattgcagccatggcccataagccatcatgtattatagtcaaaatgggtccttttccaatttgtcttgatcccaaaatccctttgtaggtaagatggttcaacaaggaactatgactcttaaggtagacttggactcatagacttgtcataactcataaagacttggaatataataattattcatttaaattataattctctactttaatatcttctactataaataccctttcaaagcctcattatttgtacatcaaacattgatattcatctcttcaatcttttgtattcacatattctatttattcaatacacttaggaaaacactttaccaagaaattaagatggagaacttcccaattattaacttggaaaagctcaatggagatgagagagccaacaccatggaaatgatcaaagatgcttgtgagaattggggcttctttgaggtaatcataaattacataaacatattaatatgtttgtttcaatttatcagtcatacttttctctgttttaaaattaatgtcactttcaatatttaataattcgcatgacatgtttataacacaacaagatataggttacattttgatacattatatataacttctgtcacacgactcaaaagtctttcttaatttcttgaattcaatgatcgatcaaactaagacacgtaaaatgaaacggggaatagtaattctgtttgcttatgtgatcattgtagttggtgaaccatggaattccacatgaagtaatggacacagtagagaaaatgacaaagggacattacaagaagtgcatggaacagaggtttaaggaactagtggcaagtaagggacttgaggctgttcaagctgaggttactgatttagattgggaaagcactttcttcttgcgccatcttcctacttctaatatctctcaagtacccgatcttgacgaagaatacaggtacatacatgtgtcctacatattgcgtatataataaataaacacaaaatttaagttatatacgctgacagtataactaattataatgttgtaccaaatgatgcagagaggtgatgagagattttgctaaaagattggagaaattggctgaggagttacttgacttactctgtgaaaatcttggacttgaaaaaggttacttgaaaaatgccttttatggatcaaaaggtcccaactttggtactaaagttagcaactatccaccatgtcctaagcccgatttgatcaagggactccgcgctcatacagacgcaggaggcatcatacttctgttccaagatgacaaagtgagtggccttcaactcctcaaagacgagcaatggatcgatgttcctcccatgcgccactctattgtggttaaccttggtgaccaacttgaggtacaagattcactaagtgtgtgtgtttttatcactataacttagaagtagtaactaaaaatggtattaatgaaatgttataaaaacaggtgatcactaacgggaagtacaagagtgtgctgcacagagtaattgcacaaacagacgggacacgaatgtcattagcctcattttacaatccaggaagtgatgcagtaatatatccagcaaaaactttggttgaaaaagaggcagaggaaagtacacaagtgtatccaaagtttgtgtttgatgattacatgaagttatatgctggactcaagtttcaagccaaagagccaagatttgaagcaatgaaggcaatggaaagtgatccaattgcaagtgcttagatcccaattcaattaaaaaaattggtgtttgaaaaatatatttaaatatagcaatctatgtatacacattatttgctcttcttatgtatggtagaataaagttagtattaaaaaagattgtgatttgctgcatatgtatcaaaaagagtcctaatatttgtatctataaataaggtgccttctagtgaaattatacaaataataatttggagtgtattgttctttctcatgtaatttaacttttaagtatcttactttacaatatactgttcacttattgaacatattgagtgatatattgactcaatttgttgactaaatttgaaaattgactagaagaatttgattgtcaacatatatacaatataagtttctctaaaatcagaagaggaaaagggcaaagagaaataaaaaagaagtaggtaagctagatgagaaattattgatcacgtgcttttaggtgtcctggtatactcaagtagtttggaaaatttgtcccattaattagtctgattcagaaaatactatggatgttgctatattgtgaaatggtcgttatactaattctaaacaatattctaattctattaagcctataaaattatcttttatcatgtgacgatttatactcttatttctttcatctttcataaagttttgtgaatttttatttacaattgaaaaagaaaagagaaaaaaagatagttatgtaggctatacaggtaaaggttatgtcaagctagaatatttgatttgcatatcaaacaggtttacggttccaaatcaagtgtaccacaaagttatcagaggctttaaatgacacccttgaaactcaatgagactgaactaggcaccacatcggtgatctgaatcagtatagaaatattgtgtcattctttacttttcacactttacctatttatatcctaagaaactaacatgcaagaaaagtcgactacaacaattttaaggcaaaagggtcaaatggacccgtatacttgtatgcatttgaattgtgaacccttctacttaattatttgtcaactaaactttcaaacgcaattgaaatgaattttttgaactcctctaaccatgtgtgtaggtcactcttctttacataaggacatgtcatatcaacatcagatatataaatgacatgtcataattacttttaaaattattaatcaaaattctttaattgaaggtaaaaatgatttttaaattttttttagaaaaataaaaatccatacattctctc

SEQ ID NO: 477 - DNA, 4649 bp, Solanum lycopersicum
tagtaattaattaacttggagcaatgtaggattaagaatttctctagaagtctcggaacaaataatgaagtagataaaaggtaggaaattaaactctagagcttttattccttaagactttgaaagtttgaataataatcttttttactaaacaaatagaaagcgaattttcacttatcacaatcaaaatgtattttcaacttaaaagaaatttttagtatgtgcgagaacaacctttaatcttgaagattcacgaagtctttgaaattagtgaagctagttgtcgtagtgactaaattaactatcaatttcaagtaacctacaacgacaagtaagtactacctataataagtctattttcatgtatagtactcatccgtttaattttatgtgatattttttaatttgatacaatatttaaaaaaaaatgaaaaatatttgaatcttatgatttaaaatgatgtataattaattaaataaacagatgatgataaaaccataagatttaaagtatcatgcacatctttgatctgttttaaatttcgcatctcatcaaactaaaatactcaattgaaacgatgaaaaaatattgttattaagtccaaactcacaattattattttgtgtatgagttgtgtttggtagggaaaagaggggacctttgtacagttcataactagtgcgctattagcatacacacacgtactaaacatacctaacgtatctcaaaattgtattatttttcaacaaattaaatactactattatatagttattatttttcatatgacttgggggtgagggtgggggtgggggtgggggttagtgtgcgtgtacatccttactactattatatagtttttatttatcatatgacttgggggtgggggtgggggtaatgtgtgcgtgtacatcctatctttcatggaaatttcttttaaacaccatgacaatagaaatttacaagtataaataagccttcacttccacttcaatgttcattcaacaaataactactaataacattcaaagactaaagatcttttttttacaagaattagcaaatatccatttcaattttttttgagaatctttggttctttctttttttgaaaattaagatggtgtctatttcaaagaataaccaaaaacaacaacttctttcaaagatagctacaaatgatggtcatggggaaaattcaccttattttgatggttggaaggcttatgcaaataatccttttcatctaactgataatcctactggtgttattcagatgggtctggctgaaaatcaggtacgagaagaaaaattaaacacatatctcgtttctttactttcggtcttttaaaaaaaaatattctttttctggttttttgaaaacttttcagaaataacttatatgtttaagattacaagattcaaaagatattttgattcattttaacatatcttgaatttaatatcatgatattcactaaccgagacaaacaaattgaaatagagaaaggaatttattttcttgataaaatggctaaagttgaaatttttttaagatatgttgttaataaatttcttatttttgatgttttttgcagctttgttttgatttaatccaagaatgggtggtgaataatccaaaagcatcaatttgcactgttgaaggagctgaaaatttccaagatattgcaatttttcaagattatcatggcttgccagagtttagacaagtatgaaacttttctaatcaagattattagttgttaattcttgtttttattcattgttctaattagtttagtaaaaataattttcaggcagttgcaaggtttatggagaaagtgagaggtgacagagttacatttgatccaaacagaatagtaatgagtggaggagcaactggtgctcatgaaatgcttgctttttgtttggctgatcctggtgatgcctttttggtcccaacaccatattatccagggtaagaattatattcgtaatcgagattcattgactcagattaattatgattcatgtcacacaaagtttgttaaagtcccctttcaattaaatggacaaatcactatcacaagtgtcttcctttgacctctatatttttgaattatttttgttgtacttggaacctagtaaaattattggtgtgggacataaaatcaactactcctctgcttaaaacagagaaagtaggtcctctaattagttaacatacttaatataattgttcccataaagtcaatgcataattaaagtaaagttttttgtatttgtaatattgcagatttgatagagatttgagatggagaactggtgttcaactatttccagttgtttgtgaaagttgtaatgatttcaaagtgactacaaaagccttggaagaagcatatgaaaaaagctcaacaatccaacatcaaaataaaaggcttacttataaacaacccttcaaatccattaggtactcttcttgacaaggacacactccgtgacattgtaacgttcatcaactcgaaaaacatccatttagtatgcgatgaaatctatgctgctacggtgtttgatcagcctagattcatcagtgtatctgaaatagttgaggatatgattgaatgcaacaaagatttgatccatatagtctatagcttgtctaaagacttgggatttccaggattcagagttggaattgtttactcgtacaacgatacagtagtaaacattgctagaaagatgtcaagctttgggttagtttcaactcagacacaacatttgcttgcatcaatgttgtctgatgaagtattcattgacaaattcattgctgagagttccgaaagactcggagaaaggcaggggatgtttacaaaaggactagcagaagttggaattagtacattgaaaagcaatgctggtttgtttttctggatggatttaaggaggcttcttaaagaagcaacatttgatagtgagttagaattatggagaattattatcaatgaagtgaaacttaatgtttcaccaggatgttcatttcattgttctgaacctggttggtttagagtttgttttgcaaacatggatgacgagacgatgaggattgcattaaaaaggataagttactttgtgcttcagccaaagggacttaacaacattgctgctattaagaaacaatgcagcaggaggaaacttcagatcagcttatcgtttcgaagattggatcatgagttcatgaactcaccagctcactctccgatgaattcgcctttggtcaggacttaaagaagggggaaaatggtatagttatgtttttgttgtttgtctaataaaagaaggtaaaaaaatatttccttttgttgtagtgatgagtgatagtactaagtatttgatttcacagttaattctatttttgtgcaaactgatgaaagaaaataaaaaagatataaggtatagagagtgttttggatttttaatatctgaaatttttcctattatcccatcaatattgtatcaaaatgggattcactgtggaatttgtatttcttcttggtttttttaattccttcttgaaaatgaaggagggtgtaagttgtaacctgaaattttacttgcttatatatataaaaaaaattcatgtccttgaaattcatttttttaagttggttttcaattttaatccaaggttgagtgagtattgatgcaacaataaaaggagtcatcatgtgaacacgttacaagttattggaacaatataggataagattgtgtaaaaataatacctagtatggataaacactcgaccccctccctcttattccactcatatatagcggaagtttactgcaccaaattatcttcattgttagcaacaaagaacactcaagtggtgttgaaattcaagttttatatttcttttcaatgttaaaccaagattagagcgagctttgggtcaacgattaaaatagttacaatttcaagctatgaaacaacctcttgcaataactcgaaccactaatgtttctccttttcgtctacctcaagtatagtgaaagtttagtagatcgtgttttttttttcaatcttaaacaaaaaattgcatactatattgttagcaacaaaaggttatgtgctaagtacaatattattgatagctaaatctgactgtcttttcaatgatagaaattaatatactccatcaaacaattagatcagaaaaaggaatcatactagcatatattatttattatatgaaagtggttggtaagttattggtatgattgaaatatttcattaattttttcaatggtgatatatactaaaatgttcatattttcttatccttatggagaacaataataattgatgttaggactttctcaacccctaagactccaactcattgtatgtttgtttgaataaaattttgatcatcacttctagttgagtcaaccagtaactcttcttgctttaatcttattcatgctgacttttgactttgtctatataattaagtcaaatactaatttaatatatttgttagtaggtatgcaacaaacttaagtctacacataatgggtcattaagaaataaacttagatagggcacaacatataaaatatgagtagacttgaaatataatactcta

SEQ ID NO: 478 - DNA, 5357 bp, Solanum lycopersicum
  modified_base (1822)..(2453): a, c, t, g, unknown or other
tatttacttgagtatttacaattaaaaaaaaatatttctgaagaaactacataatagatcggagatggttgtctagctagggttgggaggcatgttcacgagtatttatttttgttggcatggaaaattcatattcgtcttacgtgatacttgaagttaaaatattatttcaacattcaatataatttttaagtttaagttatttgattgtgtaaacatttttacacaatgagtaagtaagattaaatttcttatgcaaatttctctttttattttaccatttaaattatatttctatttttaatgttgtgcaaatacaacacttataaaattgtccttaataacactaatgtttacacatatattccttaaccatgcatataatatatcatattatcaactaatgatgataaataacttgtaaaattttagatttttttcttaagattttttcagtttgttcatgtgaaaatttttaaattgtgattttaaaattcatcatacactataaaaagaaattaattaaagatgggaccatttctagctcatcagtcatcactagtgcgtaaattaattaattaattaattataactctttatattttaaaataaatgttattttagcttttcaaattttcctttaagaaaaaataataataaatataaggtatcacatactaatttactcaatttggtaaatgttttttgaaaattagtgtttcaataaaagagtataattaaaaataattaataattattatcttcattttttgaagcaaaaattattttaaaatcttttttttacgaaatgacatttattttgaaacgacaagaatattattgaacagtcatatacttccaaaagaaaaatgcttttttcaagtctatgttctctatttcatggaaatttctgccccacaaaaaataaaataattgagaaaaacacggtattataaataggtcattcacttcatgtccattctatcatcaaccaacaattcaaaatctctttaatttctataaaatataaaataaaaaaaggtctatatattagcaaattagccaccaacaaaaacaaatttccaatttttttttcttgataaactttgagtttttttttaaaaaaaattaagaaaaaaatggggttaatttcaaagatagccacaaatgatggacatggagaaaattcagcttattttgatggttggaaagcttatgaaaatgatccatttcatccaacacaaaatcctaatggtgttattcaaatgggtttggctgaaaatcaggtatgtcaaattaattcgtatcagcttaggtgcacctcaattatttttattgtatatctgatttaatataacgataattttatctagtaagacttagacaaatgataaaaaatgtacctagagcctttctattcacttttctcgataacagctgttcaaatcagtttgcgtgcatctaataccagttaattctgttcatcaaaatttagacataactaaaaatagtccctttgaaggatgagttcaactgaattcagtatttcaattatgaaatatacactagaaaaatatgtaatgtgttttaggctaagaaaatttacgaggttgaaatcatcaagtttaaatctaacgatttgtattttcttgttatttttttttcagctttgttttgatttaattcaagaatggatagtcaacaacccaaaagcctcaatttgtacatatgaaggagttcaagattttcaagatactgctatttttcaagactatcatggcttgccagaatttagaaaggtatatatatatatatatatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactacttatatatatatatatatatatatatatatatatatttttcgataaaatataatcgttcaaataataacctcataaaatgacacaaacaacatgtatcatctgctataacaagttaaactatattactatacgatcggattacgcaaaagataactatgtaaccctagttaaaagataataatttatgatgataaagatttttttttttaaattaaactttagttttctatattgttactatttaaattattttaattattggtgtgggacatatatatacaactacttgcaataaaaatgacaaaaagtagtgataacctcaataagtttgtggccataaatgacataacatattataccaactttttattagattggaccatattgaattaattattatttgtccccaatagcagccataataatcaaaggtgacataaaaaaaaaaacaagattaaaaaaactcaagattatctagagaaagttgacttattcattaaatttttcaaagtcaaaatcaatgaatagtcaagttagaatattgatttttaacaaatatataatttttatactatgaatatattgcaggtgagatactacaagtaacgtccaatttctgtcgctaaacaataaaaatcaactgttaatcttatttaataacaaatcgagtactatttaacgataaagttcatagctaattattgcgttgtattgcagatttgatagagatttgagatggagaacaggagtacaactttttcctgttgtttgtgagagttctaacaatttcaaggtaacaaaagaagccttagaagaagcatatagtaaagctcaagaatcaaatatcaaagtaaaaggattacttataaacaatccatcaaatccattaggtacaattttggacaaggaaacattaaaagacatattaagattcatcaatgacaaaaacatacatctagtatgtgatgaaatctatgcagcaaccgcgtttagtcaaccttcattcatcagtatctcagaagtcaagagtgaagttgttggatgcaacgatgatttagtacacattgtgtatagtctatcgaaagatctagggtttcctggatttagggttgggattatttactcgtacaatgatgccgttgtcaatattgcacgtaagatgtcaagttttggacttgtttcaacacaaacacaaagattgattgcttcaatgttattagacactatctttgttgaagatttcatcgcgaagagctcgatgagattgttacaaagatatggtttgtttactaaaggattaggtcaagttggaattacaacattgaagagtaatgctggtttgtttatttggatggatttaagaaggtttcttgagaattcaacatttgatgatgaattgaaactttggcatataattattgataaagtgaagcttaatgtttcacctggttgttcatttcattgctcagagccaggttggtttagggtttgttttgctaatatggatgatgctacaatgaagattgcattgagaagaattagacattttgtctatttacaaccaaataagggagttgaagttgcaacaaagaaacaatactgtagaacaaggagcaaacttgaaattagtttgtcatttaggagattggatgattttatgaactctcctcattcacctatgtcttctcctatggtccaagcaaggaattaatcgtacgtatgtggtgttctgatcagcttctacacacatcgttcaattatggacatgtcgactatttcactgagtacctgattgtaagtttacataacataacatagaatggaagtttatatatagtgattctttgtattcttttattaaaagttttttttttttgcctataatatactatggttgcaaaaaaaaaaaatcaagttatgggattttattatattgtgaaatgtgaaattctttttttcttgtgttatatatattttttttcctgtatagctttttgtaagttgaggaaactcaatttgtaatttgagttcaagaggcaaatgcagaggatatatacctatcaatttgtagcgatttgttattttttttttttaaaaaaaaagatttattaggcagcgatttgtaaatgattttttttaaaaaaaattgtatcgctgcctgggtagcgatttccttcaaaaaagtttaaaaaaataataaataaagtaaaatcgatgccaatgcagcgatttacttcaaaaaaaaatttaaaaaaattctttaagaaaaatcgctgcacaggcagcgatttataatttttttaaaaatcatttaccaaatcgctgccttggcagcgacgatttgttaaaaaagaaagttttacaaatcgctgctacttcaacaatttaccgtaacggcaccacctaaatcactacatcaccagcgattttaccgttttggtttaaaagttttttcatttactcttttgaaatttttgtcaatattttttaccctttaggcttgggactcagatatatacctatcaattttttcatatatttatgaggaattttttttttttctaattttgaggggaaaatttaacagataaataataaaagagatagcaacagaaaataaactacaataaaataatataataaaataatcaaggaacatccgataaccaacaaataataatagaaatcgaagaactaacaacaatacaacgtatattactatcacctattgacctactatcataattcatgtctaattatccagtacaccctcgtatttttacatcatatcctcaataagctgaattcatcgatcaaatatgtgagaaatttgttcaaaagattaattccagaattagacaatatagtatctctgaaggatatcgatggaaatctctt

SEQ ID NO: 479 - DNA, 4554 bp, Solanum lycopersicum
agtttagttaaagaaaatggtactacgaagattttatagtattatacatggatttttatccattagaaccctcatgagtaataatgaaattatcatttgctcataaaaaataatttacacttctaaattatccgacgatcttaaaaaaaattgcagtaaacaaattattatagccacttaaaaaaaacattgatggtataatcatgtggtgtacacatgttaaatctttgagagaatattgcataactagtgcgatccctattagcatatactaagcatataaaattatttgaagattataaatatctcaacagagtaaataaaatatctaattaggagataatataataatatatttttaaaatgtaaataacgataaaataattaaaaatttatcttaattaacgtttctcaaagagtgtaaaagaaaaacatgacagacaatttgagaaaaggagaaagcaagggtggagtttgtacgagcctaggggccattcgaactcggttgaaaattacactgtttataaatagttaaaattatttattacatatatataatagatgttgaatcctcttcaacttcttcgtatgtttattttttctatatttgaaattcttttatgaaaattttgactcgttactgaaaaaaagtacaatattgagtcatctaaacttgcatttaatttttttttcatatgagttgtatttggtgggaagattagggaatagagggggcctttgtacagttcataacaagtgcgttattagcatacaccacgtactaataaatcacctaccatatctcaagattgcatattcaaaataaataaagtatatatttttttaatttttattattattattattaattttaattattttttgtaattgtggggttgggatttgcgcgtgcgtgctgatgatctttaatttaatgcaattgtttagcacttagaattattacaactataaataagccttcacttccacttcaattttcattcaacaaattactaaatacacaaataacattcaaagcctcttaaagagcttctttttttttaacaagaattagcaaatacccatttcattttttttgagaatctttgattctttctctttttgaaaattaagatggtgtctatttcaaagaataaccaaaaacaacaacttctttcaaagatagccacaaatgatggtcatggggaaaattcaccttattttgatggttggaaggcttatgcaaataacccttttcatctaactgataatcctactggtgttattcagatgggtcttgctgaaaatcaggtaggagaagaaaaaaatcacttatcgttttaatttgtttgttttgctttacagtattttaaaaaaaagaacgattaattttttttttgataactttttagaaacaaccgacatatttaagatcacaagatttaaaagatattttgattcattttaacataatttgaatgtaacactatgatattttaaagtcttatttattgacccgacaaacaaattgaatagcagaaaagagtatattttcttgatgaaatggctaaaattgaaattttttaagagtttttgttaatgaatttcttattttttattttttttattgcagctttgttttgatttaatccaagaatggatggtgaataatccaaaagcatcaatttgcactgttgaaggagctgaaaatttccaagatattgcaatttttcaagattatcatggcttgccagagtttagacaagtatgaaacttttctaatcaagattattagttgttaattcttgtttttgttaagtgttctaattagtttaataaaaataattttcaggcagttgcaaggtttatggagaaagtgagaggtgacagagtgacatttgatccaaacagaatagtaatgagtggaggagcaactggtgctcatgaaatgcttgctttttgcttggctgatcctggtgatgcctttttggtcccaacaccatattatccagggtaagaattatattcgtaatcgagattcattgacttagattaattacgattcatgtcacataaagtttgttaaagtcccttttcaattaaaatcatcaaaacaacttggatatacaaatcactatcataagtgtcttcctttgacctctataattttgactaatttttttgttgtacttggaccctagtaaaattattggtgtgggacataaaatcaactactcctctgcttaaaacagagagagtaggtcctctaattagttaacatacttaatataattgttcccataaagtcaatgcataattaaagtaaagttttttgtatttgtaatattgcagatttgatagagatttgagatggagaactggtgttcaactatttccagttgtttgtgaaagttgtaatgatttcaaagtgactacaaaagccttagaagaagcatatgaaaaagctcaacaatccaacatcaaaataaaaggcttacttataaacaatccttcaaatccattaggtactcttcttgacaaggacacgctacgagacattgtaacgttcatcaactcgaaaaacatccatttagtatgcgatgaaatctatgctgctacggtgtttgatcagcctagatttatcagtgtatccgaaatggttgaggagatgattgaatgcaacacagatttgatccatatagtctatagcttgtctaaagacttaggatttccaggattcagagttggaattgtttactcgtacaacgatacagttgtaaacatttctagaaagatgtcaagtttcgggctagtttcaactcagacacaacatatgctagcatcaatgttgtctgatgagatatttgttgagaaattcattgctgagagttccgaaaggctcgggaaaaggcaggggatgttcacaaaaggactagcacaagttggaattagtacattgaaaagcaatgctggtttgtttttctggatggatttaaggagactgcttaaagaagcaacatttgatggtgagttagaattatggagaattattattaatgaagtaaaacttaatgtttcaccaggatgttcatttcattgttctgaacctggttggtttagagtttgttttgcaaatatggacgacgaaacgatgagaattgcattaagaaggataaggaactttgtgcttcaaacaaagggacttaacaacattgctgctattaagaaacaatgcagtaggagtaaacttcagatcagcttatcgtttcgaagattggatgattttaactcaccagctcactctccgatgaattcgcctttggttaggacataaagatgaagaaaagaatggcttagatttgttgttgttgtttgtataataagagaaggaaaaaatttcctctgttatagtgaagagtgatagttttgatgtatacatttagtgtttgattatacaattcattccattttggatttttatcatatgaatttttctatgtaacattgtatcaaaatgggattcaatgtggaattttatttgtaagttgtaccaagaagttctatagttacacttagttaatgttgttcttgacaatattgattggaaataactctctgtttagaaataagcatggtgtttgtttctttcttctcttgtagtgttcaggtgagtactttaagtctgcgtgtctttgttctttcaagacgtctggaatcactgagctatcatgttattgtgttaaagatgttcaaaaatatgttatttaaccactttaatttttttttaaacctgtatatgtggtataattttttgatatagaccctgacatgattgtagctgcgctactgtgtacaagagtcaaactaatatgaaatcatgctgatagggctccgttcaaaagtaagtgctctgtgccaaagattttttcacattcaaaatgcaaaaccaaaaacttatgattaaggaaagagtaacctactgcaccacgttagagtattatatttcaagtctactcatattttatatgttgtgccctatctaagtttatttcttaatgacccattatgtgtagacttaagtttgttgcatacctactaacaaatatattaaattagtatttgacttaattatatagacaaagtcaaaagtcagcatgaataagattaaagcaagaagagttactggttgactcaactagaagtgatgatcaaaattttattcaaacaaacatacaatgagttggagtcttaggggttgagaaagtcctaacatcaattattattgttctccataaggataagaaaatatgaacattttagtatatatcaccattgaaaaaattaatgaaatatttcaatcataccaataacttaccaaccactttcatataataaataatatatgctagtatgattcctttttctgatctaattgtttgatggagtatattaatttctatcattgaaaagacagtcagatttagctatcaataatattgtacttagcacataaccttttgttgctaacaatatagtatgcaattttttgtttaa

SEQ ID NO: 480 - DNA, 15109 bp, Solanum lycopersicum
aaattaaataattatatttataccattttgtgcataaagttatcgacttagagtttaattttctacttttatttttggtcgtctcagacatttgattattctacaatgtaaaagtgtttgcttttgagcaagatgtaacttgtgaactcaagtgcatggtttatttggtttgtcgccttgtttctaagtgatttttaatgttttttcttttgtgttaaatcttaacgattaaatcgataaccgaaccaataacgagcaaaaattgataaaccaataaccgctaagccaatatcttaatggttctatatcgatttcacatatctacaaaccaataagccaacctgataaacttcaaaaccgaaccggccgatacacagccctaggcaggatgatggattatcttttaagaaatccagacaattttggttaatttggaattttccatccaagaaggggtaggaatgatacatactaagggtaagaataacttcattttaacggcaagtataaaatcaattaataaataaagttgaggggtatttaaaactattttcctataataataacatgctctttattaatttaatttagccttatctcatattaatgcccttcagtttgagtgtgtacatgtatacatttaaatttgtataaagttgaataaatggacaatacgttctacatagtataccacacgacaatctgtgtcatacatggtgtcctaaatgtattatagaaacgttgaactcatgtgtctatcttttaaactttatacaagtttaaatgtttaattattcatattcgaatataaatatgaagtaaattcaaattagaaaatatatttttgtattataatatttttttattattgacatcacgtaaaatgaaacggagggaatagtatgaacatgaatttgtccttaattcaaagttagaggctaaagccatgggttaagttcagctcaccagaagaggaaaaaacaagttaaagaggggaagccggaaaccttcacgtatttacgcacaaaattctatgcatctttcagcctcatgaccaaacagcccccacttgctataattaattcaagttaaagtccacaattctactttaatagcttttttacacctcaaaatttctcagaatattacaaacacatccattttctccatcctctttcttactgtgagaaaatttagagagagagaagtgtattttgagctgaaaattgctaatggcagttggtaactgaacgtttttatacagggaaatgtctggtagacgatcgagttatactttgttgaatcaaattcctaatgataattttttccagccgccggcgccgaagttctctgccggagctggtgtagcgccgtacggtgagtctagttctgctgagaagaacagaggtaaagtatttgatttggacttgatggatcaacgcatgatgcaatcacataaccgggtcggatcatttcgggtaccgggttcgatcgggtcgcagaggcaatcaagcgagggtagcttcggtggtagctcgttatctggggagaactacgtggggacttcctttgggcataagaatgagggctgtggctcgtcggtggcaaggagctgggcgcagcagacggaagagagttatcagctgcagttagctttggcaataaggctctcttcagaagcaacctgtgctgatagtccaaacttcttggatcctgtgactgatgtattggcatcccgagattcagattctactgcatcagcggtaacaatgtcacatcgattgtgggtatgacatttattgctaggaatcctttgataatttcatattggtaaaagagagaattaagagtaattgtttagtaatgattttcagctttaccaacagtgaaggatgtagtgtagaagctagttggctctaactggtgtatactttaaagattcattaaataaatacaaatagtagactttgaacttactcaatccatatagttttgaactcaaactcgtaaagttcaatcgtggatccacatatgattacaaatgtcttagctgattaagtggtggattgtgggaggctttgagtttctaatccaaaaacttaaggtaataggtgaaatggtcaacacccttataatcacgtagaacaagaaatgactatatatcatctcacacatgaattacaatatggcccataagggtgttaggatgggcatttcaaatgttggctctgatttgtcaaaaaatttgattatccaacctaaattcttttgacattaagtggaattatccgggacctttttaaactctttaagaagttctcagacaacctatgcaggacaacaatataactcagtttaggatttagtttagactattaacgtctccatgcataaagtaggtgattaagcggggaaggaatgtgcttttcaaatgcaaatacatgcataattattatatattgtaattggtggatcctttgttagagtcctacgttgatcaaatattttatattgaagtctctctgtatggttttggacaattttcacattataaactagctttcggggtgagttagacccaaagtatattcatcatgttacaactggatccatccctttttatcatgaaaaaagttcattaattattcttgtagtgtcttgattttgattcctagcatcatctattgtttattgtgtttctgctatcgcactattttgttgttgttgctgtttccttattagttgttatggttcttcactgcttttccttttcctacttcaatttgttgtactctagttgagagtcctcctgaactctgcccccatgagatatgagtatgatctgcatacactctaccctcccaaagctcacttgtgggatttcaatgggtatgttgttgttgtaataattttttattaataatggacaaaaaatatcaatatacaagaagtataccaaattgtacaaaaatctaaaatatttgtgaacctcaccttattttctaatgcttaaggctctcggctgagtagcaggagcaatttttaatttattactttatgacgagctcaaacgatggattcaaaataatttcttggcaataactttgtccactgaatagaaatattaatcacatgttccatagtcctggggctatcaattagccaaacacatggaatcctgctctttcataaattctcagttgtagagtaacccaatgttggacctgtatagtaacccaaagttggacctgtagtccacgctccagaggtccaactctgctatgtggttgtgtgttaattccatattgtttgaaagtggggattgagttgtgcgtgtcttagagttccagatggttgagaatatagactgtattctctttatatggttttatataattcttaatgcttaaactagctcttgggatggagttaggcctattgttcatttctttaacttccttcccaatttcaagagatcttaataattctactcacaacgtctttatgtttataccatgtgtcaagactcttaaatctctaaaatttgatatggaggtgaaaataattgattgcttgtgacaagggaaggatggcctagttgtaatccacaccttcaactctaaggttgggggttcaagtcactaaaggagcgaagtgggaaagtacaactgatgggctcttgcctcttgggtagggctgtaggaagtcaaacttttctaagtgctaatcgcgatcaccccttttcttctttctacttttctatttcttctttcattgttgccaaatacaatgaggctgagctgtttacactagctcaaaagttttaagcctttctcgtagtcaaaatgtgatcttggcattgacaacccccttccttttttctgcaaggccctagaaaatgatatgataaaaaaaaagtttgatcacatattcttctgttagtttcatgttttgcggtaggagctacttcatactaccttgatgtttttttgaatgtagttatactcacctattgactagatgttgcctttctattgtgattttaaattatcttacagatctcttctcattctcaattgagagttgagacagtctctagatttccaggtcatcattcctaatgtcattttattgctctggcctctttatttatgccagataaatggatgtatgtcatactttgacaaagtccctgatggattttattggatttatgggatggatccatatgtttgggctctctgctcagttgtgcaagaaagtggccgtattccatcaattgaatcattgagggcggttgatccctctaaagcaccatctgttgaagtgattttaattgatcgctgtaatgatctcagcttgaaggaactgcagaatagaattcatagcatatcccctagttgcatcaccacaaaagaagctgttgatcagcttgccaagctggtttgcgatcatatggggtgagtactgaaagctttttcttagaagctccaacagacccacttttttcctatttctttttgtgattagctttattctctctataaaggggtgcagctcctgctggagaagaggaactggtttccatgtcaaaggggtgcagtaatgacctgaaggatcgttttggaactatcgtgcttcccattggtagcctgtctgttgggctttgcaggcatcgtgctttgctttttaaagtatgtacttgttaagttggttctggtataagtcagtatatctaatttgtaaaggaaagatttaaggataaaatcagactaatgtgtgtatttatcactaaatagaaaccttgtggatattgtatttattttttatttattctacgcttagagtgatattgtttgcaatccatagtgtcttagcttggttgtcatgtacaaggttgatgttttatcattaacatctatgtaatcattacaggtgctagctgacatcattgatttaccatgtcgaattgccaagggatgtaaatattgtaatagctctgatgcttcctcatgtctagttcgatttgaacatgacaggtaaaagttcagattacatatggtgtgtattataatctttggttcatttgaaagaaattttactaggatataaagtgggaaagatactcaattcaccttttgtatacctttttcctagatagaatagttttggggatggtgtgttgagtccttaaacgaatggtagttgatgctgccacttacttttatttggataactgatacccctcatatatattgtatgaaatgatcaagatttactttcctactgctataatgtgtctgctggtaacattgtaatttgtatagatgctttctgccttctttcacgtggttattttattcatgctatgcccaacatccaatttttcttcggtttcataaagctggtgaagaaaaacaaattcaaaaaatgatttatttgtcaaaagagctgctcaatatatattcggaacatgactggcaaaatttctcgttgtaatagctaataatgtgaccttcctgatgtgataatatatatctttaaagattcagtcgctagcagaagtttgcttctcttagtacttgctgcagcattcttagtaatttagaattaagatatttgagtggaatggtagttcttactaatatgcagagattgaattttttaaatgaaacttgaaaaaacggatccactgttgatgagatagggaatgtacctaaagttgtcatacggtcttaatcactcagattttaaatcatgatccaaattccaatgcaaaaaaatccttctcttcttccatgcagccccaaatgcagataagaagaaccaaagtactagaaggaagtagaatcagatatccaaagcagactgctactttaagttggaaatagattagtaactggatatgtctgttattttcatctgttgagcttttctgctggattcagtttacatgataagacatatatagttttaaaatatgctaaacatttgtgtgctacctggttagcctcatattaggaaggagtgctagtattgacatgtaactcttgaccatacagggagtacttggttgatttgatcggtaagcctggagttttaagcgaaccagattccttgttgaatggtccatcttccatctcaatcccttcacctttgcgctttccgagatacagacaagttgagcctacaactgatttcaggtcattggccaaacagtatttcttggatagtcaatcacttaatctactgtttgatgattcttcagctggtgattatctaactctttagctgcttaaaaaatgcattgtattttgtttgttttgaattgtcctttcccaacatcttacttggcccttgccatgatatgttgacaaatatgcaggttcatacacaaatttagaattgcttcagtctagcatgctgcattccaccaaaatgcccccttttcccaagttccctttcatattgtgtcaaaattgtggtgtctgataatcagttgaacttattagaatctcctgaaaagttcgccagtatgtgtggttatttgtcttacttgaacggagtatactttcagcttgcttataacattgttcaacactgtaatgtcttaaaacacaattgagtacattgacgatccagagtttcaagtttttttttggaacaggtgaagtggtgtatattatagaataaaattagaaacctggtgttaagctggttccttgataagtacaaagtgtgaaacccttctgtacaaaaacaaaaagaaggttctctcaccagactaagcatctattcctgtagtgaatctatgaactctaacgtaccatgttcatctttaacatattgtaaggtacacctcgagctagtccagataccccataatcgtgcatccacatgagaatgcaataacaggtggtccacattttctcttgaacatctgcacataaagcactagctaacatatgtgatcctctttttcctcaagtttccagtggtcagaactgctcccttgctgccaaccaagccaagcacactttttaggtgtgctaagaagccaaataatacatgcaggaagcccatctttcctcactaaaagcttgtggtagtatgattttaattggaaaacctccatctatccttgcttcccacctccacaagtcctatctactgagtgttgagttttgtttctagaaaattttgatcaacctttggaaattcatcagtatatatacatgtatatatacatacttcgcatcttccttctttttttctgggacaacctaaatttataatatgcaaaggcaaattaataacactagtgatctaccttgtgccttgacttttatctaggaaagtatgtaaataaagtatgaaatctatttttttttaattgtgcaaataaatattagtactattttgttttggacgatttctcttcagtttttttagtgaatactagatccatccagtcctgtttcagagattcataatgattagtatttgatgtaggagctgcagctgatggagatgcaggacaatcagacagaagttgcattgatagaaacaatgtagtctctagttcaagtaatcgtgatgaaatttctcagttacctctgcctccattaaatgcatggaaaaagggacgagataaagaatctcaactttctaaaatgtataatcctcgaagtatgttaaacccagtgaacatggacgaggaccaggttcttgtgaagcatgttcctccattccgggaagatgctcaatcaccgatgacacgaccagatacagtaaatgatactaggtttcttgctggaggaggtcatgttgtttctgctataccaagtgaagaacttgatctcgatgtagaagagttcaatattccatggaatgatctggttctaatggagaaaattggggcaggtaatctgtctcctggattttagccatttgaatagtgagctgtggttgcttggttaaatgtcagttattttctgttattttttaccccttgaggggacacattatatgggattgtatagtaccataacattcttacttgattaagctaacatagtttgtctattttcagggtcttttggtactgttcaccgtggtgattggcatggctctgtaagatacttatccaattagatctcagtttttggaaatcttctatctgaaaaaatatctcaacgtatcttctacttaagagatccatttttgcaatgtgaattttttcatctctattgtacttctttggggggaaaccgtatttttgttgtagtttaatcgagttagctctgaagctccctctcaaatactttttactggcgttgttgtttctttttctctttcagattttcacttttttatgttggggaggaggggtagtctattttatgtctagtggagatacaaccatgtgaagcctgctatattacgttggtcttattccttcctgattgtatctcatggaagtttgtatcatttaggatgttgccgtgaagatcctcatggaacaagattttcatgcagagcgactcaaggaatttttgagggaggtaagtctgtgctttctcccccaacatccgactagcaatcaggaagaactagaaagggaccagaatgcacggagattgaggatctgcggacgtcagtttgttatttgtattccttctacatccttctaattctgttatttttttgggtgtcctaggttgcaattatgaagcggttgcgacatccaaatattgtactttttatgggtgctgtcattcagccaccaaatttgtccatagtcacggaatatttatcgaggtcttagcctatttctctcttcagcttattagagaaagcactttgtttttcctgatttagctgactggttgccatgttatcatgtatttcagaggtagcttatatagacttcttcataaacctggtgcgagagaggtgttggatgaaaggcgtcgcctgtgtatggcttacgatgtggtatgataaatgtgtcctactcctctcttctttctcattttacttattcactggggctgatcgcttaatatgataccatgcaggcaaatgggatgaattatcttcacaaacgcaatcctcccattgtgcaccgagatttaaaatctccaaatcttctagtagacaaaaaatatacagtgaaggtgagagtaagaactttagcaagcataaaggttcaattttctttgtcatgattgatgtattctcagacttggctgtcagagtagtcaaatctgaaggaagcatcatcctggataggacatttttttttccatttgagaggcgtcttcaaacccaacttcctcagacattttcccaagggtcaagagaagcatataaaagttgtagtttcagaatctttataacctaatcaaaattgctgaataacataaagcaagtatttatcagtttctctgatgaaagttaacttttcattccatgaaatgagttatttttcgataagagaggatatttcttgaaaattctgtgaaaaggggaaaaataattatacattatttgacattttggaggaagtctggtccataatctttctttgtgatcttctagatatatgccatctataaagtgcttatttcaactgccatttatccagcatgtttcaagaaatttaggagtcaatatgagaaggaagtttctatttccggtttagattgtctttcaaattttcttcttatgtttttccatgacatatcttctcctcttttttcaacctcttggtgcattaattttctttttaacaggaaatatttagggtagatgtgtctcctcttactctggaaatgcgtgtgtgatcctcttccttttaatcaacttggaccatcgagggaaaactaataaattcttgatcattcaatttgacttttcaaacccaaccaaaaaatgatttttgtaaaaaaataagttcttgagatctgattgagaatttgcttgagaaagaggaggggttttgggatgtccgtgatttaagaaggctctgtcctttacagctagcagcatccatagtgtagtgtgactatgtctaatattacctctacttttatttgtgattgatgcttaatgatgagaggaatattgcaagttaacaaataatttacgctagagtttgtctagaatattgaaaataatatatgaagctgttctttctctttgttcagtaaaaggtactaaatgttttctcttgtctaatgtcttcatcagatctgtgattttggtctttctcgtttcaaagcgaatacattcctttcatcaaagactgctgccggaactgtaaattcttaattcgactctgttgcctttatgttctgttgatctttgacttttttcttgatgattgaattggggaaataaatgatttggtgcttattgtgacagccggaatggatggcgcctgaagttattcgtgatgaaccatcaaatgagaaatctgatgtatacagctttggtgtcattttgtgggagctggcaactcttcaacaaccatggaataaattgaacccaccacaggtttgtatttgtttgtttgaagtattttaatgttaagagcatttaggtaaaaatgatgatttaaacagtgcaatctagaggtgaatagtttatatatcaacaaaggaccaaaagctatttcttgggatgtgaaaatgagtcggtctcatatggctctgccagggattagggcaccacaagtcgggatgagccattccaggaagagtcttttcaatttgctctgcgtcatctacactcttcttcatgtagttaatgtagaaagctaggcattcatgagccattgaatggaagagttccaggggtactaatttctatttgtgtgtaggttttattttacttcttgtgtagtcttttaatagttcatattttgtgcaacatatatgtaaacagtttgtcaaaataatatttaagaagagaactatggaagtggcggcggtgaggttgacggccagcataaaagtagtacgagtatgatgaatcatcttactataattgtaatgcctgcctatccagacatgtgctatatgagcactggagtatgtgttaaatgagctcggggtttcatcacatctccctcttaggtgagagcaaatattttttattaaaaagaaagtgagagcaaatataagcaaggtttcccacaccatatacaggtgtgactaaagaaattagtctgaccacattgacgaattaatgtggtgctctataggacaagcttgccgtgtgttagaggatggggaagaagaagctaatacaagagagtaagattcaaataagttgttggaatagacttgtttgacgggaaagcaaatagattcagctctgctagcatgtggtggagtatctgggaaggagtggaatggaagatgttaggggcattagagctcaagttcaaagtttaatctgactgtattttatggtctcttcctggtgtacaatggatgtagttgaggatgctgaaaccctgttactgttcatagatattttgtattgatggccagggttcacttttttttttctctgagtgtaatcacaacactttcttagtgctagtgacatcagtaatagttgccagttcccaaaagagaagaaggtggatgctgaaatctagagatattggtgttaaagaatgacaaaaaatctcacatcagtggttaatgagatgggtggactccttataaggcttggacaatcttcctcccttggagctagcttatggggtgtgagttaggcctaagacctaatttcacatggtatcaaagcaggtggggtgttaaagaatgacaaaaagtcggttaatgagatgggtggactccttataaggcttggcaatcctcctccttttgagttagattttggggtgtgagttaggtgtaagacctaatttaacaattggcaacatatgttgtaaaatgtggtattgtgggataaaactgggaagaaagtgggactcattgcagtattaggatttaaagtgaattgtcgaagtaaagaaaatcagcgatatgatttatctcattaagtctattgtaggaaaagtatgaactcaacatcatgggtttctatgtactacaaataatagacaagagaactaaaacaaaaatttgggaagatatggatagtaggataaccttggtcgaagagatcccatgggactagaggccatagaaggaaggtaaatgggagttggaagctgatgtagatattgtgggaagtaaatgacaagttgcattatgaaagcaataagagtagtctttggtacattttagagaggcttaggacttgggagctcaattagagaagcgtgtaaagagctgttaaaataaaaagacagaacaaatggattatgaatatcaaaagcctttaaagagtattatcaatataagaagtcagttccctcatgttcttgtagacctccatgtgcaccagtctataggtgcagcaatatgcaggttgaaggcgataagagggcacaagcacaagaagaaaagtagtttcagaagatcaatacaagcttatgtaagaataaacataatagaagaaaaaagatccatatagggtacattagctagttggattaactgttgagtttagcttttacacttattttgtgtccaattttgtgagaagttctcttaattgggtagagactcctatgttcatgtagaaataagtttgattcatggaagaccaaatgagacaatacaatatcaatgcctcatgattattaaaactgtttctcgttgatatatagtacattctagcttctgctacaagtttgatttttgaaagatcaaatagaggatcatccgtcaaccctcgtgattattgaactattcccttctcttttcttttcttttcttttttattattgtgaatggcaggaaatgtgctttaatgaatttgactttgtaggttatagcagctgtcggctttaacaggaagaggcttgatattccaagtgacttgaatcctcaagtggcgattattattgaggcttgctgggctaagtgtgtttcttttacttgttcccaagtttgcaccatttagcatcatgattgttttaatgtgttatcttaaagttacttttgatgatgttgcagtgagccgtggaaacgcccctccttttccactatcatggatatgctgagacctcatcttaaatctcctctacctccaccaggtcacacagacatgcagttgctctcatgaatacctgtgctctctgcacatattctgccgtcattgcaagccatgtttctgggaggaagaacatttggattatgtcaggtttgtctatcacccaaactgtttcttcgttacactgaattttaaagttattaccttgggtatgtcacatcttagttcaattctaggtaagttaactctaggtgactggtgccagcagtagttgaataatttggtagaatatttggaataacttctctcgatgacactttcttgggttttggtggatcctttgggaattgctggagcctggagcatctgaactgtttgtggattgagaaggcattactttagactgacatgcagccagtattctgtgagatgcccagcctaacaaacctagatatcggagtttattttcgataaaaatgggtctagctctttgctttcttgcagttccaacggcacatgttttatgacagtacttgtaagcaagtttcttcccctgtatatggcggtgaagtctgatggatacattgtatgtttttcaggcttgcatgatgtacctgttcatattaattcagattggctttggagaaaaccaagttttcttcgcaagctcaagcagtggccactgcctcacagaagatccttcgcactgggcgtgtccatttcctctttgaaccattgtttgagcaactgattttgttcaattccaattttttgtaatttctgcccaggattcttgtataactgtatgtaaaagcattataatggaaatttggatcataaagtacgtttgtttcatatgatttgttgtttttcccttgactgaataaaaagagagaacacagtttggtagagagagttccttcttagttgagcaaagaatgacgaaaaaatgagaaaaataaagagtgtcccttcatagttgagcaaagaatgatgaaaaaaatgagaaaaataacttctctagtgaaagtagaaaataattcctaacacatggactttcacattgattgagtcattgtctgtcgatatttaccctgataccacaccacgcccttgctccacctatatgtctaaaatctaaatgatacgtaaatgctttaaaaatacttaacacaagaaaataagtaaaagtgcatcagaacggtatttttcatgaaaaacattttccttcctaccaaacaggtgcatgcgttaaattgtgctctgatgtagtaatttgacaggacaattggggttccatagttttttaaaacttgaaaataagaaacagctggttgaactataaagctacagaagagaccttctcaagttattcatgaactaaaaataactaatttaattttttttttatagtactgacatttccaaacaagtagaaatacattccataatataccaaatgggaaaaatcatataatgaatttcattcaaagataagaaaaaacaaaacaacaatgataattgataactatggctctgaggtcagaaagctcccagatgatatcttttgacaacaatcacctggcattagactactttgaacgtagtagattcgaaacctactgtgaccatccgtttagtgagggttagagccaaatacgttgtgtgcctatatcttatacaaaggcagatagaacaaaatttgatttgatccagcaggagagaaccctctaagaccttacactgcagaagggtcaaacaaaaatcactcggaatccagcttctgcttcttttcttcgggcagctcctctgttgttccatgtttcaacttagcttctctacgctcccttttaactcctttggcattgtgaggcaatggcacacttccaacctacataaacgaagaatt

SEQ ID NO: 481 - DNA, 12407 bp, Solanum lycopersicum
gacgaaatgttttagtacatagatgtaagtttcgagacatgaagcctaagtctcatagatctatggagcataatttcataatcttatcactaataaaattaggaaaattaaaactttaatattttacgaaataaatttaataaataacccatgaaaatagaataagaatattatgatttttatttgaaaaaggtattagtaatctataatgaaaaaaagtattacaattagtatttaaataataataataataaaaataatatgatttaaagcaaaaaaaagaaaatttaaaaataaaaattaaacaaatgccttggacatactcttttacgtctagtctagtgcttatactcgctccatttcaaaaagaatgtcatagtttgacttgaaacggagttttaaaaaaaaagaaactttttaatcttgtggttataaattaaagttatgtcaaatgtaccaaaatgcccttaaatcttgtggttttaaacatatcacgtggaaagttaaaattacagtgttataaaaaaaaaaagggatccttttttttaaacaaactaaaaaaaaaataaaattattctttttaaaacgaaaagaatatttttaaatttaaagcttacctccgaaattctagaactttaacgccctataaatttatatgccttcaatttacgctccaaagccttttcttaacggaaattgccccacaaatgtttttgaaaacccctcctagttattgatgtaatgtgagaaaatctagtattgatgcttgtcttctacttttagaaatagttgtactttagaagaatgtttcattttccttacttttggggcacaaaaagaaaattcagtaaaaatagcgcgttaaggtcatttcgcgtaaatttactcaactccatgccctaatttagtcgccccaatatccacctccttaagctttccctcctctctttctctctctagaatgccctttacctttttacagtcaatatgagagagagagtgtatgaagactaacagtagtagcagttgattagtatatactgaaaggaaaaagtaaaggtatgatatagagagagaaacaatgaaacacattttcaagaagcttcatcattcaaatcgatcgaacgatgctcaatctacttcatcaatatcatcgtcatcttcacctgcatcatcgttgtcttcggcgtcatgtactactgatcatcggaattccaattcggtttctcaatcaccgttgagtccttccacgatttcaactgcgtcaacgacgaccactcctgctgctccagtgggggctggtggtggtggtggaggagggaatttatctacgatcaacagacagcaggactattatacttcggaggaagagtatcaagtgcaacttgccctagctttgagtgtgtcatcctcccagtctcaagatccttttccctctgatgttaattcaagcaatggtcatggtgtagggcgaaccgctgttgacttggcacgtgatagagaggatgccgctgcggacttgctatcgaggcagtattgggtaaatcttgaaaaaattcttgaattgttgttgaatttgcttccattaattttcacattgttaattaagctgatggtcttattaaacttgctatttgtgattagttcaaattcaagtgagaatatctccttatctgctgttatgaccttttggtattgtcacgctagtgtagcactttgagttgtaaacttggcaaacaatgtaactggtaaaaggttagattcagtaactgaagtgaagggttagcctttttcttgattttttagaaaatatattgttaaacaacaacaatataccccgtgaaatcctacaagtggggttatgggacagggtagagtgtacgtaaaggtacaaaggttgtttacgataaaccgtcagtcaaggtttagaacactaagaaaaagaaataagtgagttagacatggaagaccaagatgcggagttgtagtttagattacgtgtttcaagcaaaatgttaaacttggggtgctgatctatccaaaactcaagcattgcagcaccttaccatctattatataaattacattgatttgttgtatttctgtatttttcaaatagaagcctgacaaaggaattgtttagcgaggatattaaggtatgccacatatttcgtctttttttcttgtgacagggatgcagagattttgcaaagttgcaagcacattttctctattcagcttcttatgtttcttagctggttcgagtttaaacattccgtataatggatatttaagtatcataggtgataagactatgactgcctaacatctctgacatgctatttttaatttgaaaggcacatgcatttttttggttcaataggatttgtcttgttatatctgtcgtttgtttcatcgtaaagatttgaataggttcctttcctaacaatactttatcgattcggttattcccttttgggcctcccctctaaaagcttaataatttctattatatagctaattcctggaatatgttttctattgaagatgattgtcagtttggttctcataatttggtttccaatcttttgtctcacttatttcaggattatggtgtgatggattatgaggagaaagttgttgatggcttctatgatgtatataatctctttacagatccagcaagtcgtgggaaaatgccatctctttctgaacttgaaacaaatcctgggacttctaactttgaaggcgtgataattaatcagagaattgacccctccttggaagagttgatgcagattgcacactgtattacattggactgccctgccagtgagattagtctgttagtactgaggctttctgaacttgtaactgggcatttaggtggcccagtaaaggatgcaaatatcatattggccaaatggatggaaattagcactgagttgaggacatcacttcacaccagtgtgttgccaatcggatccctaaaaattgggctttcacgtcaccgtgcactgctttttaaggtgattatcataataaaatgttgtgcctgtttctttcattgggacagagggatttaataacttgccatccataataacaagcattggatagaggcgatgttacttggctttccgttgattagatatacttaattgatgtttgaacagtgcttattacgcttggaaataggtgttgaggatcttttgcgtaaaattttacaatttcttcaacagtttaggactttttaataatgacaataaaccatttacttaactgttatccatgataaacctctatcaaggaaaactttcaatgtagaaagttatagttacaatttaaaatgatttttctgcctaaatctgtttgcttcatctcataggtaatatatataataaggctatgctctttatgtttagtcttgcaatatttcatctattactttaaagttttagattagatgcgtgttctctttcacaactttcaatacatttagcagagaacttgggaagtacctctcatcttcaagaatctttagatgttctgtaatctacctagagctgggccaatttaatctgcatcattaatttacaaagcttttgttaccttgcaccattacaattcaactcgaactatgcagagtcttcttctgtacttgtgacctcattcaactggacctcttaaactttgtaaaggtatctttgagagggttgaatgtaattcttttattttaaccacatataagtatcgcttagtgggaatttttctattgaagtttggcaacgttatgctcttatggcatttaagtgactagtgtcttgtctaataagatttgtatcatcttcatcgctgttgtttttacttgaggcaggtactagctgaccatgttggaataccctgtagacttgttaaagggagtcactacactggtgttgaagatgatgctgtcaacattgtgaagttaccgaatgataggtgaattatgaagttcaatagcttttctcaaatctaactatagtcatcaatccaattccatgaaacacatgatctttcttcatttgtcacttcaaactgtatctcttatttgttgcggcaaatgcattattgtgcagatgtgcatgtattgcgacatttgtattttattgatttttgttgtgtagctctctacattttcaacctctaaatcaattctttgccttcagcgagtttttggttgatctcatgggagcaccaggcacactcataccggctgatgttctgagtgcaaaggatgcttcttttaacagtccgaaattgaacaagattccaagtttgccgtccaatagtcattctggagtttcctacccgagacggaacttgttatctggtcaaaattctgtgttaggagatgatttctccggtagatctaagcccgagaagatagaatcagttcattcaatctctgatgcaggtggtagctccactgctggttcttcaggaatcaacaaaagaccatcttctaatcaggttgattggacttcaccgttagcaattggaacttctttgtacaaaggaggccgtggacccaatgccgctggtgatggcttgaggttgaatgtaaatgttgttccttatgatcagaataaccctgaggatccaaaaaatctttttgctgatcttaatccgtttcaaataaaaggctctggcaacacattactgcagaaaaatcctgctagaaacaaagtcagtgagttgcaacagccaataaatactttgatccccggacggcctcctgcccctatgatgtggaaaaatcgatatgcacccaatgaggtgccccggaaaaacgaatctgattctgagggactttttccaaagaagaacggtggatctagtgggtataatatatcatcaatcgcatctaccagctcaaatataccgcagaagtcttctactgatacctccaggttacatggaaattcacggcctgcctatagaggaaatgatgaggttgcttccactaggaataacagttccatattatcagctgagcttgaatttagaaggttgtctgttcagaacagtcaaaacaataatagagaaacaagtcaatgggaggggcacagtttgcagagtgacgacttaaataggacacaagcatatggagatgatattattgtggaaagtgatcacacaagaaatttgcaagctcagtcaataggaaccaatattaaattgaaggagccagaaaatccaacttcttcagggaatctaggtccaagtcaggttgatcctgtgtttgatgatgttggtgattgtgagattccatgggaagatcttgtcattggcgagaggattggtcttggtaagcctttattaatcttgattgaaatatcttgcgatgacaatggtgcaaatgcatttaaacctcatattttttttatatttgtacaacactttatctcaacccgaagtttcattaagatatatacttacttgggtttgggtggggccagtaaaaatatttatttatctccaatcatttccatccattggatggggaaatgaatagtaaatgtgagattttctaatattttctacctagtgcttgtcatgaggagtgaatagtgtggatgtctgtttatgtaggtttaatattttattggagatttctcagttgcttggttcataaaggtgaaaataaaaagggactcaacttactctctcatctccatctacatgaatgcaatcaaagatttgtccactgaatcattttgcttttgtgtttctatatacactaacagtgtaatgattttaaacactgtcagtgacttttaacttgtgatgggaggttaattactatttttatcagatcactggttgatgcctatcaagaggtttacctgtaattacctaataagatacatgattgtgtaaatatcttttcttcaccctgaacttctgtttctattttcaggttcctatggagaggtttaccatgcagattggaatggcactgtaagtgatttcatttcaaatattcccaggagcgtttaatttcatgttcctattaattaattgttactagccatgcaatcagattaatggcttaaagttctgagttgtcagtgcgttctttgctatatatcctctatagctgtcaaatttcatcaaattccagtattctaatgtgtgctttttgtatcatcaaatattttgttgtcattaagtgaaagcttttgtattgatgtaattgcttgagtgtattaaatattgagtgtgtttgcttgtgaatctgtctataacaggaggttgctgtaaagaagttcctcgatcaggatttctcaggtgcagcgttggctgagtttaagagagaggttaggattctgcactgttatgcttactgcttgatgcctgcactgaagtataaaaatctaaagagtactggaaacacgttctggtttccagtgctcttctaattttttaaaagaggttatgcctgtatagtcccaagaaggtgtggtacatgtttccagtactctaatttttttaaaagaggttatgcctgcatagtcccaagaagctggtcctgtaattttctggttctgtataatcacttctagaaatgtactgtcattcacatttatgatagatctaaaaacctgtttgactaaagggaagttttattagctgttggtttttgcatttatgggtgtctgctggcataacctcgtattaacatcatcgtgttctttgtggtggagtccattgtagctgtaagagaaccttttgtctgttttcaagagtcctggatggtttgcccacaaactatatgtgctggcataatctatctgaagaccaggtttaagttgttaatttgacttaaaggtattttagtgccaacatgaatctgtaacagttgttatcaattctccctatcatttttgttctatcatgtcgttaactctcaaaatcgtgcaaggctctcaaatggtctgaccattagatgttcccctcatcatttgaaatgggtcagggctttattgaatctgattgaatttgaccaggggatgctctcatgaaaactaatattctgttttgccaaaaattgtagacacatatgaagagaatactaggatagtggttgaaaagttagattgatagagaagacatcaaattaaagttacaaattttgagtagcaaaaaataatttggattcttgaaagttgcgagaagtgtgtgaatgatattattagtcaatggtgtcatagtttttgtatagtaccaacttgaaaagagttgtaaaaattggaatgaagtactcttcgatattttattccattctattcatagaaagattgacttacccttatatcgggatgtgaaaatttatgtcaccaaatatctttgttgtctttactacctaaaaatgacatgtataaatatttcccatcacgagcatgacttgtgtatcttccattcttgtttcagtttatgtttttggttttgaaaagataagatttgtattatatcactgtaatatcaggttcagatccaaaagtgacaaaaatattaggtgatttttttttcatttgtcctaagcatgggtggacagagttcctgcacctgatgctggtgagaggtcataggtatctcatggaattagtcgaagtgtgcaaaatctggtctggacgcctcaatcatcaaaaaaagtttatcacagtattccatcctgcagtaaaaaaaattcttgcaggtatccataattacaaggggattattgggaagatcttctaatcctatatcaaaaacttacaaggatcctaacatatccataagtgaatctggatcttccatgtattcccgttaccaaaaataaaacaacaccaagcaattcattttcagctactgaatagtattgcagttgttctcaaaacttctctgattcccttctcttcacaccagatactagcagggataattttccatctctccttttggatagagaggctgctgtaactatccagacttccaaagcatgcacaattctccctagcatcacacatgacattccttttatgctagtaaataacctctatagctgagttgtgatcttacaatgcaggaaaagatgattaactttcagctttagtttgtcaattccattttcgtaggaccttgtttgacgagaatagtaggtctgatcttctacattagctgctaatcagtttcggataggtcttcttgtgtactttgaagagatattcctcagacgtaatgtttgtcgtatttcttttgtttgctgctcaactttcttcctgttaaaatgcatcattaattaacatattaacatgattggttcttaatggcaggtgcgcatcatgcgtcgattacgacatccaaatgttgttcgttttatgggtgctataactcggccgccccacctttctattatcactgaattcctaccacggtatgcttgtattttaatttcaaccctttttttcttccatattgttatcattagtaagattttggttattgtggactttttccttcgacatacttgttctgaaaagatatgggttaggtgcaagcactcgatgcaaattattcactatacatttaagtagtaaaagttgaatatatgtgtaccagttacttgccaatacttgtttcttactcatatttggttcggtaatccatgtaaaagatagtgtccactggtgcaaactacaaagagagcatgattcttttatattgtgcataaatcgttgtatcagtttccctatatatagcaccctggacgttcttcattcaggcctaataagtgtttggaaaaaaagaagcagcaaaaacagttaatatgttgagattttaatgattcaaaccttacaaactatgcatctctcatattcactcagctaacataaatattcttctgggtgtctttattagcaattaaggatgatgaatccatgagaagaaggtttatcatttggattaatatttatttattataaacctttggtttgatcaccttataattgtttccacgttatatggtttttgagaactctccaagaattttcttctaatatgatgtaaatactacggagatgaatgctaaattctttccttgttgtgttcgatttgtggtactacaaagtgccaattgttgatgtctctttcagccatagttattaaacagtatctgattatggcaattaataagtgattttgaaaaaaaattcttgtgaaggatgaattactcatccaatatatcatgcttttcagaggtagcttatatcggataattcatcgtcctcattttcaaattgatgaaaggcagagaatcaaaatggcccttgatgtggtaaggtttaacatcatctttacatgatcaatattgctggatcttcggaccaattgatcagcatatttttgcttatgttgatctttgatgttctcttattgcaggcaaagggcatggattgcttacatacaagcaaccctacaattgttcaccgtgatctgaagtcacctaatcttttggttgatacggactggaatgttaaggtaattcgttttctaatgttttcatgttctcgttaccttgcatgaactggtgttatttttgagcgagcaaaatttatcattttctcctagtgttatggttgagtgcaaggtgggatgtgtgaattagctcacattatgagtttgaaccttgtcgtggagatagttgggtatttaagtggagagaagtgggaaggatgaacctaatttccactggacttcgaactgctccccaatcagcccttgaggacttctcggttactaaaagttgttcttattatggttataaaaaaagttgatcttatttatggtttgttgagttggttgtaaaccctaaatgtttcagtgcaatgctcaccgactgtgtgaactttgagcaaacttttgtagcaatgcaattgtgtggttttgttcattttgaagggggtgtatacttggttgtggttgtttgtattagtaactctggatctgtgagaaccattccttaatttgtcggatgtctttggagagactactattagtaactcttaaatcttggaatgcaggtatgtgattttggcttgtctcggttgaagcacaacacatttttgtcttccaaatcaacagctggaacggtgagaacaatgtatctgttttctattggttagatgtattccgttgctatgaagtttggatactagttatttcctttcttcacttgctttcgttattgtctaacctagttttttaattccatagcctgagtggatggcaccagaagttctccgcaatgaaccttcgaatgagaagtgagttaagaatttctttactaattccatgttttcgctcatagtctgtgcagagatattcttgtagtttcaaacttataaaatagtgaatataacctggaggattgtagtggcatagtctgttggtgaactcttttaacactccgtatcttaattttgaactgaacgtggtttccagaatgaacattttcctttgtggaattcttggtcacgtaggatgaaatgagctcatagatggctaagttttgaacgtgtttattttgcagcagattttgtacttgctgagttctccatgctatgtgttcctcggctaaaattttggtcatttgacaggtgtgacatatacagttttggtgtcattctatgggaacttgctaccttaagattaccttggagtggaatgaatcctatgcaagtggtgggagctgttggcttccagaataaacgccttgaaattcccaaggaacttgatcctatagtagcaagaataatatgggaatgttggcaaacgtaagagtgacatacacctttatcttttcttttttcaagatgcagaaaatgctaattacctcgtacatgtattttttccagcgatccaaacttgcgtccatcatttgcacagctaactgtggctttaacaccattgcaacgacttgtcattcctgcctatgtagatcagctgaactcccgcttgcctcaggaaatctcagtaaattctaccccgtaaatttcctcgtcttcctcaagtgctgatcacttgggaaaaagaaggtttctggtttcgctcatttgcaaaaatggaaagattcttggcgaagtgggtaaatggttcttgttgctcagagatgatttaggaagaaaaagcaaaagcaaccttggtagtggtccttaaatgtgttgttacttgtatagtggttgtgtataagttgatcccaaagggaacgggtgtctttctgagttgtatagtcttaatgatcataaattcgttggttgaaaaaccccccttcgaaataatggggtggtgccgcacataatccctgtatagtctatacaacagaagctaagttgtctcttataatgaatatatatggttgccttcaaaaacagtactacaatatctcacgtattatgccaaatctttctttctttagtttgtactacaactttgaatatctcaatcgtttatgtcatagctttaacagagcgttagtatttccccatagtctctggatagtaaaccataaaatcaaccacatttgcagttttcttaatgcttgtataatttgttattgaaccttggcagagaaatccagcctcctcaaaaccttatgagaagccttgttctgcgaatcagcataccaagctttacaattccaggaaagtcaatgaatatgcgagggattcttgataaaactcaacgcttcttttgaattcaaagtattcaatcaatgtatttaaactaacaatacaatatatcaggtccaagcaagcaagttataaatgtcatgaatcagtggaaagaaaactataaagtacaacgtccttgatttcacctttgaagtaaaaatactttctaaacataccctcttttctaaacccagccttctccaacactctatgtgatgctttattcttagcatcagttaatgcttgcagtcttactatttcaggaaactcttccaaaatcaaaggaattgccatctctacagccttgggtgtaatcccctgtccccaaaactcaactgctaaagcatatcctacctcggcccgacacctatcatcgcctgatccgggccgagccaccacgattccgactgaacgatcgtcaatgcatatggatcgacgccaaggaatggaggatttgtggatgaaggtgagggcttcatctttggaaatcaatgtactgaaatggatggagcgggttacgcgatcatcggatgcccatgagagtacatcatcaacgtccgttgatctgtatggacggagagtgattcttgatgaatccatttagctagactgatgtaagatctatgctcagccttgtaggatacacttcta

SEQ ID NO: 482 - DNA, 5100 bp, Solanum lycopersicum
tatagtttcttaaaaaatatgtaaaatcaataggggacatatattgttagatagagcgagtattttgtgatttcacaaaaaataatagtaaaaaaaaattattttaaattatgtctttaatatttttcttaatagacgtgaattgtctcacaaattcagttattatgaaagagatgaattagtgttaattagatgataaaaattttgacgaattttcaatcttttatcctgcattgaactattttttattttttttttaaaaaagatatatattaggaatggagccacactataaattgtaaatactaaaataaatgtgtcaaatatttttataaatcagttatatatagatataaaatttatattcataattctcttttaatctatttatttataaaattagtcttttctttcattaaatattgtgaatgaaaagttgtgattttagtgaagagttgcgacttttaataaaaattatgacttttatgaaagattgtaaccttttcgaataattgcaacttttttaaatagttataacatttctgataagacataataaacatttgttcatactattctttattattcataaataaaggaatttcctctcattttaacacaacaaaactctaaatcacctcttcttcttcacaatcaaatatttattagctcatcgctattattcaagtatggtgtgtatttttactatcattaatttataatttatgattatatcattaaggataaataataagatataatactttttatttttctttaacattattaatatttaaaattatgtaatcttatatataaaataatttaatatcttaaaattttaatatataatagattttaaatattattttataaattttgtaatacttactagttaaaaaaaataaaaaatacacaatcctatttaaatttaaatgtagtaaatattttattttgcatgaagggagtaataaatatattcacattcattattaaagttgttgttctataacgtcccccaccctttcttctctatttcttacttatctttcttctctgtttccatatagtctcttaaaaaatggtcaaattattattctcctaagtagagaaaaagagtttaatcaaattttttcaaatatcataaattcaggtactcacatactaatagtttttatgtctctgtcttctttacagatatttgcttttgtactttcttctgttaattagtgatctttaatggagttttttttttgttgttgttgttgtaaagatttgtgcttttgcttaaagattggatttttatgtgtttatgattcttgattggttgaatttactttcttttattgtttataattaataatatgatgtttataatcatagttgggtgagttacaagattctttttactttcctttcaaaagaactttttttttttttcagatttctgtttggggggttacattaatattgatggtttggatctgggaaaatatgttaattttttttttggattttcgcgggaaatgatttgtacctatttggtatttttggggagattatcttgggtttttctttaatgtgcaaaactctatggttttttttttttttatgagtaatgtaaaaaagtccacttttttctccccttttagcttttagttgaacttgcctgtgtattgagatatttacatgtcaacagtgttctgtattgttcatatgtagaactttgtaaagagattatccctttttaaatgtatttgcaggattaaatatcgcgtaatttggattgatgagtgttgagaaaggacaggataatctgtgaaaaaattgggtgttagctgctagttctgtttagatttcttgacgtttggtgattagttttttggaggagtttgttcttgtgaagatgatgatgtttgaggaaatggggttctgtggggatcttgatttctttcctgctccgcttaaggaagtggaggtggctgctccacagactgaggcagagcaggtggtggatgatgattatagtgatgaggatattgatgtggatgagctagagaagagagtgtggagggacaagatgaagctgaaaaggctgaaagaaatgaatcaggggatggaagatgttgattctgtcaaacgacgccagtcacaggagcaggcaaggaggaagaagatgtcgagggcacaggatgggatcttgaagtacatgttgaaaatgatggaagtatgtaaagctcagggttttgtttatgggatcattccggagaaaggcaagccggttggtggggcatctgataatcttagggagtggtggaaggataaagtgagatttgatcgcaatggccctgccgctatagccaaataccaggctgagcatgctatcccaggcaagaatgacgtatcaaatccagttggtcctacccctcacaccttgcaggagctgcaagataccacccttggttcgttattatcagctttgatgcagcactgtgatcctcctcagagaagatttccattggagaaaggtgtttcacccccatggtggcctacaggacaggaggactggtggccacaattgggtttgcagaaggatcaaggtcctccaccttacaaaaagcctcatgatctgaagaaggcgtggaaggttggtgtcctaacagcggtgatcaagcacatttcccctgatattgctaaaatccggaagcttgtgaggcagtcaaagtgcttgcaggataagatgacagcaaaagaaagtgcgacttggcttgctatcatcaatcaggaggaagctttggctcgagaactataccctgatcgttgtccacctttatcgtcagctggtggtagtggaactttcactgtgaatgacagcagtgagtatgatgttgatggtgctcaagatgagtgtaactttgatgttcaagagcaaaaaccacaccatctcaacttgttgaatgtcactgttgagagattcaacgagaggcagcctctgcaacaacagtctcatcctatcaaggatgaaataatcaccagcttagatttcacccgcaagaggaagcaatccaatgaacagactgttaccatggctcagatttatacatgtgagattcttcaatgtccttacagtgaacttcgccacggttttcaggacagatctgcgagagacaatcatcaactggtctgcccttatagaaacacttctcaatttggagtttcaaagtttcccatgaacgaagtcaagccagttgtcctccctcaacaatatatcccgtcaacttcagttgctctgcctgttaatccaagtccacctccttttgatctatttggagtaggagttcctgaagatgggcaaaggatgattgatgaccttatgtcattctatgattgtaatatacaaggaaacaaaagccaaaatacgggaaatgttgcagtgaccaaagagcagcagcctcatcaacaacctcgtgttgaccaggtcaattacctacacagtcgagggatgatggaggggaatatcttcaaagacattaatgtttccgcaagtcagtctatgcagccacaaggcaatcttgttgatcaatgcaagatcctaaattcaagtgacaatttgcaattcatgtttgggcctccattcaacttacagtccaccaattaccctggaagtctgcctggcattggatgtgacaccacaccgaagcaagatattccaatttggtactagccatgatattggtgaaacgtatatagtcagtcggggcttcatagatatagcttgttccccgagattggcacaccccattataattggtcttcattatcaggtggatttttaatcgcttacaactctcttagtcaagatatttcctgttaccatatgttttagagggttgaaagctaggcggcatggtgtaattgaggagaaggaagagaccccctcaagtattagccaatgctgcttatagaatgtatagatatctgataaataagttaagactatcttgttatcttgtgttgaaattttggtttaatccaaacttcagttattttgatctcgccgtttaagttttcttgatcgtctgcatgttaatgttttgatctaaagcttgtagcttttttcagcatgggctgtatcagtatttactgctgaatttataggcaggcgaaggcagtctttcgccatacagttctttaggttgtttcatgtttgagatttctgcccttttgtagcatagttattgacgctgccaaagctgtgtaagaagctttcttctatgatctttacctaatgtaacattattgcttttatgcaatgaaccttttcatttcctatgcaataacatgactttttattgagtttcctttggtcatgtttctccaggcttgtgaacatacttgtcttgagtgcatttctatggactattgcgctaacttatcctgctcatatttgaatattctcgaattaacggatacgcgactcccaagtgtgttgcttaatagtcaatgtaagttttaacatctgtagagactaaaaatactgttaggtgactccttactattacctcatactagtgggtgataacaggtgcctgttagaatagttgaggtacgtgtgagttgacctgattaccatcaagtaaagtgaggaaatgaaaagtaatatgacagggatcatgtgaatagcagatcacaattatttatattcatttctaacttaagaagcaacacatagtattggctgactccttcacattcaatttacttgtgattgattctactttactgaactatatttaatattttcctttaataaagtcattacttttgcttaagatctccatcatcaataattgaccattaaatctttgtttaaatgcaaatgccaaacattaaaaaaaataatcattaagctggttacaagtcattgggaggcatcaccaaagaccgtggccaagtgaatggggttgctattcctttaaccagagattatgcagcgagaatctaaatgttgtcagacttcactacgaatatcagacactgagtggaaccaaaaagaaagactttaggaggcacaaaactataatatgaagcaatatttgt

SEQ ID NO: 483 - DNA, 10138 bp, Solanum lycopersicum
tattcagttactctttgatactatcagagtgtattttatataatataatatgttgtattaatcaatactaaacctcaccaaaataataatctcaaagtactaaacactctttaaattaataaatataaattatcaattaaataatacatctacaaaataatatcctatctatattaatttagtgaggttttaccatagttgcttgattataaaataatatatactttaatattttacaattaacattaataatttgctctccaagaaagtatttttcaaaacctaaaaataaatatcaatcaatatggatgttataataactatttacattaattattattttttagtgaatacacaaaatcttaaacttaacaaataaaagtaaatgaaaaaggttaaaaaccagagatagataataaaacaaaaaaacccaactaactaatgcgcgaaattctaaacttgacagttaaaactgaacgaaaaagatacaaacgagaaatatagcaataaaacgagagataccacaataaaataaaaaacccaactaactagcgcgcgaaattctgaacttggcaggtaaaactgaacgaaaaggatacaaacgagaaatatagtaataaaacgagagatacgacaataaaaccaaaaacccaactaactagcgcgcgaaattctgaacttggcaggtaaaactgaacgaaaaaatacaaatgaaaaatatagtaataaaacaacttttaccgaatttcttcgacataattctctcaaaacaccttaatatactgtattttatttacgtatgtatctatgctgaatataatggagaaaaaaaccgattaaaaaactatctttttagttcacttttctccttcatagcttttggactcacattagtgaagtgaaactctcaactttttctctctctctccaagatagctttaagaccctacccacccccttacatgacccccttttccccataatatatatataaatacagtaatatatatgtatatatatatagtttctctctctacagtagtcacagctcacacaccataactctccatctctctaggatatgtattatgtacaggttcctctctttatctcttagtagtatatatagatattagagcttccttaaaagcttctgatctgaactctgagcactgaaatttatagagaagaagactgaagaaaacccatccagaaaaggaaggaaaactatttgaagaaggtataaaaaagaaatggaaaaccctaatggtctacacacccacttgggtaaattttatcatttttttttaattttactgttatgggtatgtttagatataggtataaggattatatgttttggaatcttgaaataaaaatttggtctttataggatatgtttgtatcagatccgatgaagtgggtattgagttttttgctgattgttttgatttgttgtattgggttgtgttaaaaaggttggagaagtgttatttatggggttttggtttttgggttggaaaaagatttgatcttcttttatataaatttgatggggttttgtagttttgtgtaataaagatctggatggttgaggaggagaaggtgtttcatttgcagttctcttcttttctttttgaaaagtggtattgcttttgaagtcaagttgatgtttttttttgtttcaaaatgcaggatatttttgttaaagcaatcatgtttagttttagatgccaggctgtaacatggagtttactgagtgttttaattattttttttgggcaagttgactaattttgaaatatatgaataatgctggattggtttgtgaattgtgatctcagtgaaggtttgccaaatttttgtgttccatgtttctcgcgctacaggacactgtgatgtatgttaggtcgtgaaagatccaatttttttctgttgggtagtttatcaacttcagcatttttgtcttttaactggaattaacatgtatatagttttagtttggatataatgctttctccagctgttttaagtgtttgatagtcatggttacctagttttttctgtaactacaatttgaatacttgactgaagttttggtatttaactcaattcagaaatcagaatcggcaatcggattattgacggatgcaaaggtgttaatgcggtgtatttggttggagttggtggatttagcaactcgaaaagacttccatctttataaggcgcacttctcaaagttattgttcgaagttggttgattttagcagcttgaaaagactcttaataaattgcttttgtcaagttcttcatgtccattgcttttgggtgcaaacttgctcaaaattctccagagataacgaggggttttggtatcctgttctaactgtgctacattgagctacagtctacagttggagctgcagctgctacatagaaaagctgtgtggtcggaacttggaacttcactggttggattgtgagcttgttcatgtcaaatgggttgctaagtgatgctgtagtgctagtttactgcgatctctgggcttgctaaccatttaaatcaaataatggagtctgaaactctgactagagaatataggcagcccagcatgcttcagcgagtactttctgcttctgtgccaatgctgttgattgcagttggctatgttgatcctgggaaatgggctgcaatggttgatggaggagcccgatttgggtttgatttggtcatgctagtactcttgttcaattttgctgccattctgtgccagtatctgtctgcttgtatagccttggttacagaccgagatcttgcgcaggtagtgttcttccattggaatttaacttttgattgtgtgtctaagtagtgatgaatcttagtaaatcgaagttgattctcctgctcttgtatgtttcatttagaatacccatagcaaggacagttttttttccttttttgctaacctggtgtttgggccagcttgtgcacatcttgtattttgtttaactgatgatgtataataactttgttgtccttgatggtgtcaaagatttgcagtgaagaatatgacaaagttacatgcatattcctaggaattcaagctgaggtttcgatgattgctttggacctcacaatggtagtttcactatttcattttgtgtgcactctggcttccgagattatgacgttttatagctcatcaacttacgactacttgattctgataggttttgggcactgcccatgggcttaatgttgtgtttggagttgacctgtttagctgtgttttcctgactgcaaccggtgccattttgtttccactgcttgcttctctctttgtaagtcttgctactaactatccttgtggactttctgttattggcatcttgaattatctcagattcttttcgtatggtcctagtctctcataaataataatgatttcaaaatactatgtctaggacaatggcagtgcaaaattcttatgtattggctgggcaagctctgtactgctctcttatgtttttggagtggttataactctacctgaaactccattctccattggtggtgtgctgaataagtttagtggagagagtgcatttgcattgatgagtcttcttggagcaagtattatgcctcacaatttttacctccattcttctattgtacaggtatcctctccctctctctcccctctctctctttatgtgtgtgtgtgtgtttgtgcatgggcatgcataaatattgatctgtgcatgcagaacggaggcacgtctgtaacttataaaacagtctgtcgctgcactgattgttaagataattattggtatgctagattggtccctgataactcaaggataaatgtatgttcagtctattttgttgttccgaccagtcatgtgtgaatagttgtactgctttcttagattctgtagctctttaagtctagaccatccatagtcatgtgaggtcctctctagatttattggttgtggctggctcccaagtcttaacttgtactatgtaatggggctagcttatctacttatttactctttgcatcttctagatgccagtaataaaacaacttcatcaaaaaaaaaggttggcctgataaatctttcacacaacaaactagcagacactagccccttaataaacaatattggcatgtatgacttgttatgcatgatgttgatcgcatgaattctgtatttgcttctgtcttttggttgtcagttatgattcctgaccttactgctcatccttgggacttaggttggcttgaccatgatcaggacagttacttaggttgactcttaaaagagataaaatctgttgaagcaatccgtgattctaaagcctctattgttgttaagattttcatgctagggatcataatttttatggtggatgagtttatttcttcagaaaaaaggaaaccaaactacatcaaaaatagtgttttctctctttttccccttttaagggggtggggcgtgggggaagtgagaaggttaagggggaagtgagaaggttaaagagcatgttgaatatgaccttgtgttgcctttgccttttcatctgcaccgagtctatctgtattatataatatatatgtgtatcccagagccgtaagccaatattcacagggcaagggtacataggcatgattccaacagtctagaagtgtgaaatatgttcagacatgctcaaatcatcaatgatgtgtcaacatcctttttgaaaaaaatgatgcgtctttgtcattatcagtggatgtggtttttttgtgcagcccaagtatttccatgtttctgaagcatttttttttggatattgaaatgacagatttttagaaatttccatgtttcatattatttgtatggtttccattagtctcagcaattatcacagcctagaaataacttttaatccacagcattttgatttttcgactcgttgctacttgtgttggtgtgatcaatactagactatctcgtctttacctctatataaattcttttctgcagcaaggtaaggaatcaacagagctttccaggggagctctgtgtcaggaccatttttttgccattgttttcatattcagtggcattttcctggtcaactatgccgcgatgaattcagcagcgaatgtgtcttacagtactggccttttgttgctgacatttcaggacacattgtcattgctcgatcaggttagattcaaacagcaaaagatggatccgtctaagcttgggcctttgtgaaccagagatattaatacttttcgtttattattgatacaggttttcagaagctcagttgcaccattcaccataatgctggttacatttatttccaatcaagttacaccactaacttgggatcttggtagacaagcagttgtgcatgacttatttggaatggacatcccaggctggcttcatcatgtgacgatcagagttatttccattgtcccagctctttattgtgtatggagttcaggagctgaaggcctatatcagttacttatactgacacaggttgtggtggctcttgtccttccatcttctgtcatacccctgttcagagttgcttcttccagatcaattatgggtatccacaaaatttctcagttaatggagttcttatctcttggcacatttattggcttacttggcctaaagattatatttgtcatagagatgatatttggaaatagtgattgggttaataatttgaagtggaatattgggagtagtgtgtctactccatatgtttttctcctcatcgcagcctctttatgtctttgtctgatgctgtggttagcagttactcctctgaaatctgcaagttccaggttcgatgctcaggcgtttctgcaaacgcatgtgcctgagccatattcagagtgtaatcaacttggtgcgagtaatgctatgtttggtctagtagaaggatcctcccaaaagcaagaaggtgcatttcatgtggaaaaatccttggtaacccatccagatttatcaactaaagatcctgatcaactcttgccagaatctctcttggattttgaaaaggtccatcagttggctactattgatgagagcaaatctgaaacaacattttcagctcctgctgtcgttcatcctgaggtacctgtatcagcaggagcaagtcccagtgtgaaaagtgtttgtaatgaggtttctggtgttgtatcagtggataccagtgtcttcaatactgaaactgtggatgtcgcagagaagactctcagaattgaaggggacatggcaaatgacagggatgatggagattcgtgggaagagcctgaagaggcaatcaaaggagtatctgagaacgctcaatcttttatttctgatggtccggggtcatacaaaagtctaagtggaaaactagaggacacggggagtggtacaggaagtctatcaagattagcaggtcttggtcgtgcagctaggaggcagttaacagaagctctaaatgagttttgggggcagctttttgattaccatggcatggcaacagcagaagcgaagtccaagaaactggatataatacttggtctggattcaaagatgaatccaaaacctgcccctgcatcattaaaagttgaaagcagtgcgtatattccatcggggagtgcaaggataccagagcctctgatcaactcgcatgtgtactctcccaagcagcaatttgcgtctaacattgtggactctgcttatagagtcccaaaggagccatcttcgacatcttctatgtggtctaaccatatgaaattagtaggtgcatatgtgcaaagttccaacagcaacatgcttgactcaggggagaggcgctattctagtatgcggattccagcgacttctgctggctatgatcagcagcctgccactgtgcatggatatcagattactgcttaccttaatcaacttgcgaaagaaagaggatctgattatttaaatgggcaactggagtcaccatctcctcgttctgtatcatcactgacgtcaaactatgcagaaccattggctcgtgtttcggggcaaaaacctcagagtggagtcagtagtcgagcaccacctggttttggaaatgtccctgtaggccgaaataattcgatgcagcccactaacactacttctgtcgaccatagctctactgaaactgctgaaagcgtggctggttcagccaactctaagaagtactacagcttgcctgatatctcagggcgctatgttcctcgccaagattctatagtgtcagatgcgagagctcaatggtacaattccatgggattcggacaatctggtggtcgatctacatacgaacaagcctatatgagtggttcactaagggcaggtggtcctcagaggtatgaacattctcctaaagtctgcagagatgcattctccttgcagtacagctccaattcagggactggatccctgtggtctagacagccttttgagcaatttggtgtagctggtaagccagatgttggtagcggcgatcatggaactgtgctgagttcctctgctcaagagagtacatctacggttgacttggaagctaagctgcttcagtctttcagaagttgtattgtgaaacttttgaaactggaaggatctgagtggttatttaggcaagatgatggggctgatgaggatcttataggtcggattgctgcaagagagaaatttctctatgaagctgaaactagggagataagtagattgaccaacattggtgaatcacacttctcttccaacaggaaacccggttctgccccaaaacctgaagagatggattacaccaagttcttggtgatgtcagttccccactgcggagaaggttgtgtttggaaagtagatctgattataagcttcggtgtgtggtgcattcacagaattcttgagctttcacttatggaaagtaggccagagttgtggggcaaatatacctatgttctcaaccgtcttcaggtaaagcctcatatcctatctatctttttcttcattcacagaattcttgaagttctatgtttctttcaataatttttttttgagcattggagaaatgaagcatgctttttggtgttaccacacaatccttcatgaaaaccctctttaaagcttatatcacatcatttaaggtttaaataaaccgcatttgtgttagattcattgttggaccttgtagcgtgccaaaaaagatattgtagtgactatcctggtccttccattttaaggtggctaaacaagtgctaaaagcatcaaagacgccacaaaaccgtaagctaggggtcatttgtttgaaattttcctttctcggaacagcgggaaagagtaatagttgagttggtcttgatgctcaagaaatggcaatgtgtcaaccgtagtgtgagatttattattcatctgatgaatcatttaccaacttcagggcatagtagatctggcattttcaaagccccattctccgacgagccattgtttttgtcttcaaattccggctggccgccagcaaaaggcaagcccccctccaatttctaatggaaacttgccgccacaagcaaaacagggtcgaggaaaatgcacgactgcagcaatgctcttagagatgatcaaagacgtggagacagcaatttcctgtcgaaagggacgaacgggcactgcagcaggggatgtagcctttcctaaaggaaaagagaacctggcatccgtcctcaagcgctataaacgtcgattatccaataagccggtaggaaaccaggaggtggctggagtcgccggaccgcgcaaagtaacgctgtctgcctcatcaccccctttcgtcttgtaacgctcttttctcagttcatagcaaatgactggtgagatcaccattgttagacttgttcttagtttctgtgaattatccccccctccccaactatacctcccttgcacctcatgtgtattttgaatctttgcagcttattcacccccatcccttgtacctcaatctgtatacataggataaaatgttgtaacgaggttactgtaaaactgcaatggtgaaatgaaacgggctaaaaggcgggaaaagatgttattacaagatatgcagttttcttgctttttgtttccatagtgccatcttgaaccaatggaaacaacctctacctctgaattacttttaatatcaaaaggttgttgttatattactactttccttgatccgagggtctatcagaaaccacctcgtcctctaagctctgaggtaggcataagaaaccacttggtcctctagttccgaggtaagcgtaagttaaacgtttcaaactcattatgtgggactacacggggtatgtgttgtgttgtagtttgcactttattgcgcaagaggggaaagtgctacgtaataggtgtttttcttacttagggtttgagctcgtcacattttatttaactaaagattcttagtgattccatcgcaactcattattggttgttagaggagaataatacttctctcgacataatatgagaaactttgtgttctcaaaatatgtaaataacttttgtgtgattaattttttgtgacataatatgagaaactttgtgttctcaaaatatgtaaataactttttgtgattaattttttgtttttttttagatttgtgacctaattgcaataaaaggagtataaagatcaaaaaggatgaatgtgaatggctagaagaggacaaccatattccaataaaaaaactctttatccttatctttagttgaaattattgtcatcgttataggttcaataaaaatttaattattaattttttgtaaacatatataaataatctattttgaaaaaatagtactacattattccctcttatatttcaaatttcataaataacacaatagactgtgatttagtggttgatattgagtcaaatttttttattgaaatttaattaatcgaatcgataaattttatttcgaaagaaaaagttaaatgaattgtggtctatcatcacacacgtagaataaagttggtgtctttttcattcttctttctattgcattatatcactctccacttatcttttctttctta

SEQ ID NO: 484 - DNA, 2994 bp, Solanum lycopersicum; identical to SEQ ID NO: 225
  modified_base (2655)..(2994): a, c, t, g, unknown or other

SEQ ID NO: 485 - DNA, 3136 bp, Solanum lycopersicum; identical to SEQ ID NO: 226

SEQ ID NO: 486 - DNA, 9669 bp, Solanum lycopersicum
catatttctttacctttcgagtaaacactatgtgataaaaactttaagaaataaatatcaattataaattacgattatatgttatcgatcatgatattcatgattattagcttttgctgagtccataggtttgtgttctatttatcaatgtttacataaaagataatgtttaatccttaattcgtatataattctacattcatttaatttcaaaatggtaaccctataagtttctactaaaattccgataaaaatagtaagtttaatcaatcaattaatattcctttttcaaattaaaacattaatcaatagagttgtaagtaaccatacctcttaaaactttgggcttggaatgagaaaatgaggtaagcttagaaaatgtatttggtgttttaaagttgtaatttttctaatcaataaaatagatatcaaaagtctttaaattaattggatgaaaatgctacatgttcgaaatttaaagaaaatcgtgaatataattagataaaataatattaatgatgaaattgaagacaatataatacaattgaaatcaattccatataaaaagatacttatcaaactagtctttaaattaattggatgaaaacgctacatgttcggaatttaaagaaaattgtgaatataattagagaaaacaatactaatgataaaactgaagacaatataatacagttgaaatcaattacatataagaaaacacttactaaacttttcatgttttttcgttgttatttcaaaagacaaacaccaaacttaaaagtaacaagaaaaatgagagatgaattttaactagatttaagttttcataaaaaaataaaatactacaattgtattttattaaattgtctaaaatatttttatcgtgttaaaagaaaaagtcattttacctcagagaatttattaatccaataatattaattaactgagctactaatattctcggtgatcataaatatgaccaccaactaaaaaaaaatgttaacacatgtatgaagctcttcactgtagcagcgtgattccggtgagtagtttaaggctttttttttttcctcttaattacttccctccacttttagttggggagcttttctcgataatcgccaaatttccataaattcaaatcagtatatcatcgaagaacacgacgaaaatccgatggccacaagcaaaacgacagttcaaattcacggagattgtgaaaatgataaagtgaagttacgtggagtagtagttcagtgaagtagtagatactgagatcgcattctccgtcgtcatttttcacatcgaaatagtaatctctttctcagatttgtactttttttttgagtttctcgttgttttctccgcttgaattgatactgatctgattttcatgttttaggtcgtgtaaaaaaatgaaaaaattgctgcgagacaggtatgtgtcgcagcaggaaatagcatcttaaaggaaggaaggaaggaaactcgaaagttactaaaaatttttggtaattagttgctatgcctgaagtatttaagtttcggtttggctgtagatttttgaagttgaaacgtaaaaatttgagtttttggagttgtgatttatggaatttgaagttgtgtttaggtatagattttatttgtaaaaaaattgaagttttgtgagtataagtaccccaaaaaattgaaaatatttgaagattagattttcaaaatttgatcaaatacatatatgaagatagattttaaaaatctgtggcaaaatgctagctaaattatctgttatttatgtttctctatggtgtaacttctttttcttcttttgttaaatggaatttgattttgaactgtaaattgtagctttattttcgatgtccaagggtttttcaatttgcagataatagaaagagtgaatttgattctaccatggttttgctattagtgcataaattccttccaagttgctattttgattggggagaaggatatgtgtgcttatctattacttagaggaaatgaaattgagtgtgaatttgaattggcatggatccataaccttttagatgcataatcttgtagcctcatggaggttgaaaacccagagttgccatctaatagattaatcatcagaaaacaagcaggtataccttttggtaagttcaggagataaaaaggtattttcttgccttgtttttcttttcggcgtggtagttgaaatgtttaacgatggaaatgaatgtaaattgtaccataattacgtaggagcattccctctggagaaatcctataatagggcaaacaccaaaaatagcttggagttggagaaaaaccatgctctacttggtttcttgttattcattctttccgtattactatgaaagcttagatattgtagacagtgaattcaagtaaactattccttccgtcggaagatcaagaaattgctactccctccgtttcattatacttggcacctattctagaaatgaatttttctttttactagtccattttagcaaaccaagagaattttattgttttctttctatactacccttagaactctctctagtccatattgagtgaaattttaggggtaattgttcaaagttcaacataattttttaaacttctttccatatttgcacttctctttaatgaggttcttagctatactttatattttctaggatataaattgcacaacttacaaagttgtatttacgatttcactttgaatcataaatataactttgtaagtagtgcaatttatctcctagaaaatgtaaatatagctaagaacctcattaaaggaaaggacaaatatagaaaaaagtttcaacaattatcttgaactttgtatagtttcacttatactgaactatgaagaaaatcccaaaaatttcacttaatatggactagagagaataccactttaaatttttcattttttcaatctatatttgaaatcgaaaagtgaattaagagagctaagatttcatgtatcttgatgttgaagacactgctaaaatagttcactactttgatgttgaagactctgttgatgctgtagaaattttctggttgaattttgaggtttattattgtgctgaaattttcaatttaaatgtttggctccaattgtacaaacttttcatcatgaaactaatgtcaatcgcttcaatacaaaaccaaaagtttgatgtcatgcagtgtaaaatttttacgtcgggatttcaaattgcttccttaacttatacgagtaattatcataatcaaatcactaaaccttttaggtaatgactctttctacttttaagaatagtttgggaataagcaaaagggcaataatggaaagtagactttgaactatgttcttgaatgtgtttcctaaggagtgtgccaaatccaaaaatttcgctcaatatgaattagaggaagcattaaataaccacaaattgtagtagtagtcaaatttaaagtttcaactgtcatcaataagtttagttttaaatacacccctgtaaaagctttcttaagggttgtgcctaatcaacatgggtcaagtaaaatgaaacaaaggaaatattattttagaataactgtgacagcgtaggaagcttctaatttctttccttaaactgctaactagtggtaatattaaagacacagatcagtttttttggttgcaatgatcaggaacacttgtataaacgtaaaagcaataactaacaaatgtatgtccactaacgtttattaatgtctcttcattcattattttttccctcgaactgcgataaacaaatgtgtgcactgcacgacaaagatgtcgtggacaatggtgtatgcactttttattgtcagttttactatttatgaagaaccattcctcattctgtctttttcagattctttgggacgaaacgagataatggaatcctgtgattgcattgaggctttactgccaactggtgacctgctggttaaataccaatacctctcagatttcttcattgctgtagcctacttttccattccgttggagcttatttattttgtccacaaatctgcatgcttcccatacagatgggtcctcatgcaatttggtgcttttattgtgctctgtggagcaacacactttattagcttgtggaccttctttatgcactctaagacggtcgctgtggttatgaccatatcaaaaatgttgacagctgccgtgtcctgtatcacagctttgatgcttgttcacattattcctgatttgctaagtgttaaaacgcgagagttgttcttgaaaactcgagctgaagagcttgacaaggaaatgggcctaataataagacaagaagaaactggcagacatgtcaggatgctgactcatgagataagaagcacactcgacagacacacaatcttgaagactactcttgtggagctaggtaggaccttagacctggcagaatgtgctttgtggatgccatgccaaggaggcctgactttgcaactttcccataatttaaacaatctaatacctctgggatctactgtgccaattaatcttcctattatcaatgaaatttttagtagccctgaagcaatacaaattccacatacaaatcctttggcaaggatgaggaatactgttggtagatatattccaccagaagtagttgctgttcgtgtaccgcttttacacctctcaaattttactaatgactgggctgaactgtctactagaagttatgcggttatggttctggttctcccgatgaatggcttaagaaagtggcgtgaacatgagttagaacttgtgcaagttgtcgcagatcaggttttaattgctaacttcctttatcttattattaactggttagaagcaggtcagtgatgtgtgtaaagttcagcatagtctaaaaaagatgtatttcatgcattagtttttagcaaatgaaagttctcattcaattttcccaaatcaagacaaaaagaccgcataaaatgggaaatgatgaaggttttgcacaaatactttattttaccccttaagtgttgtactttattcaccgagcatctattcccatttttgatacacctatccacactatctctaatgtattcacttgcttaggctatattatccttgtcttaatgggtgcgatgaacttataatgctagaacaatgtcggtagctactactttccaatgagagcacatggactatgtcttgcttcttgattagctgcataattttcacctttccaattctttgtccagaatttttttggtatggttatgttctatgttgctcagactctggtgtcggtatctgatataggtacagatctagaagtcagatccttcattatataaattttaggattcagggttattgatacggggtgctatgatatggtcaataattgtatatcatgacatataaagtataaatttgattaattaaagttattgaactagaaataacaaaatttaattctttataaacacctgatatattcataagatatctcgtgtaatagcgaagccttttcatactttatataaccatatatatgacataaacccaaatatcaaaccaaatagccaatcaatctgtacacctcgatcatagatgtagtcaaagcacccaaagtaagtttgccaactcctatgtcaatcccacaacgtcatgggtgcggtcgggactttaaagattctgagcaacataaatatgtcaataaattctaatgttggaagccttatgacttgaaacatattgctgaagcatccattaaatgaataggtaatgcatacagaagacatgcattccaccctcctatttattgaaaatttaccaataagaagtttcttcagtagaacaccccccacccccaagtaaatgtttaaggagtggataatgttgcctgtaaataaataattaaagatagtcgcataatatcagagtgattagaaggagaaagaagacagaactaatagataagttatatgggagatgagttttcgttcttttacttacctcatttaatttacttggaactgaaaggaacattggtgcacagaattgcaacttaagaatgattatttctctttgtaatcatcatgggcaattttgtctacagataaatgcattaattgcagtgcgggtaaggatgtttaggtgcgttaatagctgctctcttttgtcaattggattctactccattcttaaatttatgctggttttctgtccaatctttgcccttgctttctattttgctctctgaagttactttgtattagcaaccctaacagaacaagactgctacgtgttgtttactggatccatgacacaaattagaacttgtccatatcagttttgaattagaattctgtcattttaagtacaatcatgtaatagtaacagaacaaggctgctacatgtcattatctgaagaacagaaattagaacttttgcatttgatttcttattagcattgtcatttaagtaagtgtaattgcttatcaggttgctgtcgctctttcacatgctgcaattttagaagattccatgcgagcccatgatcagctcatggaacagaatattgctttggatgtagctcgacaagaagcagagatggccatccgtgcacgtaacgacttccttgctgtgatgaaccatgaaatgagaacgcccatgcatgcagttattgctctgtgctctctgcttttagaaacagacttaactccagagcagagagttatgattgagaccatattgaagagcagcaatcttcttgcaacactgataaatgatgttctagatctttctagacttgaagatggtattcttgaactagaaaacggaacattcaatcttcatggcatcttaagagaggtatatgacgacaaacctatgctatatctagcatacactggtaatatgttgattttctctagtaaacaggtagcatgaattcattctttacattgatttgcaggccgttaatttgataaagccaattgcatctttgaagaaattatctataactcttgctttggctctggatttacctattcttgctgtgggtgatgcaaaacgtcttatccaaactctcttaaacgtggcgggaaatgctgtgaagttcactaaagaaggacatatttcaattgaggcttcagttgccaaaccagagtatgcgagagattgtcatcctcctgaaatgttccctatgccaagtgatggccagttttatttgcgtgtccaggttgagcatttctatcctcttatcatggcttagtggttgtactgtgtttcttcatgaaatgagtttgcatacaaatgcatgcagttctaagagctgtttgttggctcgttcagggaaaaagtgtcatttgttccaaagccagcaaagaatcaggatacaaattgaaaccctctttgaatgctaaatctttctattaaatgtgaacatttatgttttcctcttcccttcagattgtccgtgtatttcagaacagaatctccttttgttttcagttacttttatcgttgtaggaggtttactttgcagttctggattgtttatttcgtctcaagttgaatatcattcagaaaggagatcccaaacttgaaaattaatcctgttcagattatgttcttgcaggttagagatactgggtgtggaattagcccacaagatataccactagtattcaccaaatttgcagagtcacggcctacgtcaaatcgaagtactggaggggaaggtctagggcttgccatttgcagacggtatgtttcaaattgttaattcgagatcatcattttttcctagttgtccatattataaaggcttctacaagacatcctctgtttaccttgccttactcgtatgttgctttgtaccttggttatcattatttgtactcatttgacatttgagacggatggatgcagatttattcaacttatgaaaggtaacatttggattgagagtgagggccctggaaagggaaccactgtcacgtttgtagtgaaactcggaatctgtcaccatccaaatgcattacctctgctacctatgcctcccagaggcagattgaacaaaggtagcgatgatctcttcaggtatagacagttccgtggagatgatggtgggatgtctgtgaatgctcaacgctatcaaagaagtctgtaaatgacaaaaggacattggtgtgacaaagaacattaaatcatgactagtgaatttgagatttcttcactgttctgtacactccaaatggcacagtttgtcttgtaactaacctaattcaatgctcgtaaagtgagtactggagtatcttgaaaatgtaactatcgaatttatacatcgagcttttgacaactatgtgttaggcctaaaaaatgcagaaaattatacggttgtgttcctatgcagcggaacaatccctttgtagtctagtcctgtttgtgaaggaagtaatgtgtcttgcaattgggtttctaagattatgtaagcaccaaactagttttcgttcttcgaacatcaaggtgaccgatgaacgttgtgaagtttgcactacttaataagtttacaaaatcatgtatttgaagatcataattgtctaaaaagcactatgaatataacttatttcattgttaatcgtatatatattagccaaaaagggatttaagttgttataaatatttcattgttaatcgtgtatatattagccaaaaagggatttaagttataaatatttcattgttaatcgtgtccatttattttcattcttaccaaacacacttcaaacatgatgatctaagatcgcttgcttccttggcatagtggaccaccaagcctcaaccttcaatcaagcattctaagacgcaccgataattagactacttctgtgaactcaacacagagtacgatcaagagcctgtttcgattgacttatttcaagtgcttttaagcacttgatcctatgttaaaataacaagataacatcaatccagacaagctcaactagagcagagcacagtttgcctgcaaaactatctgaagtcaccttgagtactctatctgatgcaaagtaataatatgaccaaaggtaagcgcaaaactgaatacaacacaagaataaagtatcaaaacttccaagcatctattcaacttcatgtaggtaaaacattgattcttaaagtacatgaaccaaatagggaacatataaaagatactaaactggcataataacaaaaaacagatataaagccaaccctccttaaagttcgccatcctcacttctttgacttcttagatcctcccctgcaacaaggacagtattcatcaaattttgtttcaaggtacttgataaactaaaagcaaatttgtgataacttactgagcagtcttggctgggggtgctgttgctgctggtgccggggctggcgctgcaggttgtactggcttctctcctggtccctgtgaacaaggaaaaaaatgcctcaattctattgggtgttattgtaaatagttgaaatgtgctactgacaactagttagggtgctcgtcagtaaacagtctcaggtgatgaaccttaattacctgggccaaacgttcctccctcctagcgaactttctttccctgcttgccttgttc

SEQ ID NO: 487 - DNA, 6253 bp, Solanum lycopersicum
aatttaaatatacatcttcaacatgacataataagtcgtttaaaactctgatagaaacataaattcttgataaaaaatggagaacaatgttgaaaacattattgctcgctcaggattctgtctttagtcagttggtaactttctgagccttagtgcgcatggccttgcttcctttgcgctcaccaatgagcagtgaaagtcccggaacttgttaattgactggctggcttccgaaaggaaccggagctcttctagccactaacggctcataggcctcctcatcccgaaagggaaagggagcagagggtaggatatgatcacgtgagggacacgaaggcattaagaaagcaatcgcccccccctttgatattatatttaatgagaattgaatacatctctctcatattgtaaaatcgaaaggataaataaatttatctaatcaactaaggaggtattttcaaagcaatcaataatataaaaatgaacttaataattcacgttaaatttaagagattttttatttttttggacaataaaaataaattttggtgctctgtatctcaaacggcgaaatttcagcttcacctccgtttttgccccgtttccattggcccctccggccaaccagtatgtctgcgatactgtttcgtatgaattttctacacgcgccaccgttggcgcgtgcattttcgtccatttggcacgtgggctattacattcctctctctctaggtggatacgtcaaaactatatatattattccccggtatcgatgtagagatggagagagaaagatggcaatagattttgaaagaattaaataaaataataataatggagtctagtagatggaaaaaatgactactttattgtgcaaaagtgcgtctaagttctcttcatgtaaggtctatggcccccacctacccccaccccccctcctttagattcttctcctttgcttccattttcttctttcctacagcaaacaacggcgacaacaaaacctcttctttctctctctatatctctatatataaatatatgggttgtaatggcagtctctttttctctactaatactagtacaagacacttgcgtattttaattttttcagaatattagaagtttcattagtaagaatactgagagtttttttttgttgttgaaaaaagggaagtgatgaagtgaaaacccggatttgccccttaatcacctctagttttgtggtggtcggggtgggggttggtgccggagatcggaaaaaactgaaaacaggttgcaatgtggtggcggtttatttaatcaggttgtgggtgcattgggtttttggttaatttgggtttgttgatgataccaatgcatgtgaggggaaatggagtttcggataagaagaagatgatgcctattcttgggatctgcatgtgggggaaccataagatctcagtattggattggttttgctctccaagagaggatgtctatatttattctttcttctggtaattatgctctgcaatttctttttctggtttttactttgaatttcatgtttattttaatggtttaacttgatctgctttttgtattttggtgattatgggttgacgtgcatagtggatttatgactccggatgaataaaatagttttttttttgatttggcaagttaatattcttttttcaacttgttggactagtttttgtcttttgagactgtgctctatgtttatatattattgcaagtggatgttggtgcatgcatttgtttctattcttgtatgtaatgatgtcatgatgccattttttaatctattatattaaatttaaaggtgttttcatgttcttggctaagaaattgttgaactggaaatgaaattgacaacttgcttgtttcatgcatatgtggttttgttggattttgtcaggtttatgattagcgttggtgctgaaataatgatttaatatagtaaatgggctgaagacgacttgctcaatgttgaggacgttagcatcagctttgttggttttgtccttctttgtttccttatcggctgctgataatggtttcccgcgatgtaactgtgatgatgagggattttggagcattgagagtatcttagagtgccaaaagattagtgatctctttattgcgattgcgtatttttccatcccaattgagctcctttactttgtcagttgttctaactttccattcaaatgggtgctcttccaatttattgcattcattgttctgtgtgggatgactcatttgctcaatttctggacttactatggccaacacccgtttcagcttatgcttgctttaaccatttttaaagtcctcactgcactggtatccttcgccacggctataacccttattaccctctttcctatgctgcttaaagtcaaggtgagggaatttatgctgaaaaagaagacttgggatcttggtagagaagttggattaataaagatgcaaaaagaagctggatggcatgttcggatgcttacacaggagattcgaaagtcacttgaccgtcatacaatactctacacaactctggtggagctatcaaagacgctggatttgcataactgtgctgtttggaagcccaatgagaataaaactgagatgaacctaattcatgagctgagagacagtagctttaatagcgcgtataatttacctatcccgagaagtgatccagatgttatacaggttaaggagagtgacggagtaaagatacttgatgccgactccccacttgctgttgcgagtagtggagggagtagggaaccaggagctgtggctgcaattaggatgccgatgcttaaagtgtcgaacttcaaaggtggaactcctgaacttgtcccagaatgttatgccatactggttttggttctacctagtgaacaaggtagatcatggtgcagccaggaaattgagatagtcagggttgtggctgatcaggttgctgtggctctgtcccatgctgcaattcttgaagagtctcagcatatgagagaaacattggaagagcaaaaccgagctctggaacaagcaaagcaggatgcacttagggcgagtcaagcaaggaatgcatttcagatggttatgagccatggtctgagaagacccatgcactcaatattgggtctgctctccttgttgcaagatgagaaattgggtaatgagcagcggcttcttgtggattcaatggttaaaaccagtaatgtcgtgtcaaccctaatagatgatgtgatggatacttcaacaaaggacaacggtagattccctttggagatgagatattttcagctacattccatgataaaagaagctgcttgtcttgccaagtgtttgtgtgcttataggggttataatatttccattgaggttgacaaatctttgccaaatcatgttctcggtgatgaaagaagagtttttcaagttattcttcatatggttggaaatcttttgaaggaccccaatggaggtcttctcacatttagggttctcccagaaagtgtaagtagggaaggcattggtggagcatggagaacaaggaggtcaaactcatctcgtgataacgcctatatcaggtttgaagttggaacaagcaataatcattctcagccagaggggaccatgttgccacattacaggccaaaacgctgcagtaaggagatggatgaaggcttgagtttcactgtgtgcagaaagctggttcaggtattctattgctaataccagcatctgagtatgtatattctggagtttataaaccaaaaaactgtttcatttggttctattcccttctttctgtggtttatagtacactcaactttgataaaatcattctgttataggttaaaagagaaaaaatgatagtattacaaaagaaaaatgatatttaagcctgactagtttttaaatttctactgcaattggatgagaccttttaaattgtgatttctggatggcgttaactactacaatttccatgtcaaagaagataaagcaattcatgaccttgattgcctgtcatgtaattaaatatgtcgttttccctgtgaatgagaaatatgatactaaagttgcttaagctgtttgttgcggaacttttaatccccatttgtttgggaatgaaatctgaaaccactcatacaagttggtagtaccgtagtacttgttctcttttttctcccttcgattataatttaagtgcatatagttgtggtttggggtaggcactaacatcttgctggtatgcaaatatgatgaacagttgatgcaaggagacatctgggtaatcccaaatccagaaggttttgatcaaagcatggctgtcgttcttgggcttcaactgcggccatcaattgccataggcattcctgaatatggggaatcttctgatcattcgcatccacactcactcctccaaggtgttaaagttctgttagcagattatgatgacgtgaatagagcggtaacaagtaagctacttgaaaaattgggatgcagtgtttctgcagtttcatctggacgtgactgtattggtgttcttagccctgctgtatcctcattccaaatcgtccttttggatcttcacctgcctgatttggatggcttcgaagtaaccatgagaattcggaagtttggtagccacaactggccattgatagttggtttaactgcgactgctgatgaaaatgttactggaagatgcctgcagattggaatgaatggacttattcgtaaaccagtgctattgccaggtatcgctgatgagcttcaaagggttctgctacggggaagtagaatgatgtaattgatgttgacggtgccttataggagtggagtttataaggcagggcttcatcaaccacgtaatgctagatgttcaaacgaaattgcttggaccacttcccacccctgaagattccagcatacagatgtaacgtacatacaatctttgaaatcaaaatggtacagaaaatatatcgtcttttctactctcataaaagccctcagctctaaaggatttgagccaggtttgccgattctacatgttattgagcttagcaactcagaatatttaactaatctgttgttagaactgaaaagtatatactgttgagaaatgactccagaatagctccatttctaagtgttctggagcactattagatttgcatttgcaggaatatttattgccaattgaaaattttgggtgaagaatgttcaaaaggctggtctaaaatgtaggcttatattgaatatgcattcacagttatactaagatacttcataagatgaaactaaacatacttctaaaatgcttaccagaaaagatattctagattgagtgtttaccttgtgtccatggggaatccacttagcaccctttatttatgtatgtacactatacctatatgtcaacaaatttttgtttaaacaattatgagcttccctagtacctttttctcgattgttaaggtcgtaagtggaggatgcttactatctgatcatctcttcttttctatatgttgattataatctttgaccgagttaaatccacttagtttcctttcgagtgtgtttgatatggagggaaaacattttttcatgtctggttggacaaaattttggggaatgttttctttaggaaaaatagtttttaaggggaaaataactttattaaagagcaaagtaaagaaaataagtttcataagtgatattttatgtttattgtattctctcctttcgcccaagttcctttttttacttactttccaaacagtagaaaataagttagaaatatttacaaaaaaaaatattttccttcgtagcaaacaaatccaaattcgtgttcacttttttttttttaaaaaaatagtggatccccattattcaaatccaattcatctttaatctattaaaacttagatagctatataactcgaattgacaagatattttgatttgttagataaagttataataaaagaataatttattagctactaatatatgtgaagaacaattaaagcaattaagctttgtaaattggttggaccgagtcttgactcgttatataattcattacttcattcttttttattcaacccgttttattccaaacaaaattgggttgaattatgtgactcaattgttttcttaatctattatgacctgtttaaatttcattcaactcaagaataatttctatcttgttagaagagaaaaa

SEQ ID NO: 488 - DNA, 6253 bp, Solanum lycopersicum; identical to SEQ ID NO: 487

SEQ ID NO: 489 - DNA, 6159 bp, Solanum lycopersicum; identical to SEQ ID NO: 467

SEQ ID NO: 490 - DNA, 4236 bp, Solanum lycopersicum; identical to SEQ ID NO: 452

SEQ ID NO: 491 - DNA, 4910 bp, Solanum lycopersicum; identical to SEQ ID NO: 269

SEQ ID NO: 492 - DNA, 4843 bp, Solanum lycopersicum; identical to SEQ ID NO: 271
  modified_base (1)..(89): a, c, t, g, unknown or other

SEQ ID NO: 493 - DNA, 6117 bp, Solanum lycopersicum
tcactcctcaccgtccatcaggacacttctactttcctcaatcctcaccgtcctcggcttgcttacgtagtaaaaaataaagaaattgtctatgacagatggaatacgagatctaggtaagtctttctttttttgtcaactttaatgctacgtagactttattttattcttattttacccttataataaatattagttataaacaaatttgatatctcaattggttgactacctgaacatttatcttgttagcaacgattcaatttcttattttataatttttcgtctcatttctcatttcccgtgttcccattatacttgcaataattaaatataaaatgtaataaacttaatagattttttcatataattttttaaaaccgatataatattatttgtggaagcttgaaagaatgataaatcaaggtgatatatgtacatactagatacatttatttttccaaacatgtgaaaccactaccaatctagcattcaatagaatttcctaacaataaacaatatttgaaataacgaaaaaagacaaaaactttattaaatgatagaagcgtttcgcttttttagaattttttctacttttattacccaaactaaaatttcaaaatctacttttcccatttaaataatttcattcttaaatccttttatttatttatttttaattataaactggggtctggggtggcaacagtgggggctggttcttaaaaacctctgtggccggtcactctatcgttctcaaatttcactcgtaaaaattttactgaatattttattagttcaatacattttaaatttgataaaagatcaaatcagatagataaattaaaatggatgaggcaattaaattattcatgaaaaatacaaaaaaatttattacttttgactaaataaataaaaaaaggatattattctaccacatgcatgactattgcctccaaaaaaacactataaatacccccttccattatccccttttcttataacattcaaaacccaaaattaaaacagagcaattttagtttcttagaagaaaaaaaaatggagaatggtacaaaagggaaacttacagtttcatcttctctacaaattgaacagcctttaccaccatcaaagctatggaaaattatagttgtagcttccatagctgctggtgttcaatttggttgggctcttcagctctctttgcttacaccttacgttcaattactcggtattcctcatcgatttgcctcttttatttggctttgtggacccatttctggtatgattgttcaaccagtggtcggttactacagtgataattgctcctcacgtttcggtcgtcgccgacccttcattgccgccggagctgcactggttaccattgccgtttttctgatcggattcgccgccgaccttggtcatgcctccggtgaccctctcggaaaaggatctaaaccacgagcgattgctgtattcgtcgtcggcttttggatccttgatgttgctaacaacatgttacaggtaattttcaaatcgaaattcgaaaattaaaattgtgtttgaacatatatttaatcgaattattactgttttttttttaactagctagttgctatattttttatataattaaaatcatataaagactacatgcaatacaaaattccagctagataaatgtaaaaaaaataatataattttaggtacaaacaaaaaaaaatagttctaaatatttgcttaaaaaataattaatggaatttcctcaataattattcttttctaataacatgttttttaaaagatcaacaactttattctgttttttttaataaaaaattataaaaggtcacaagttgtaatttatttctagtttcacttagttatatataaaatttgattgtttcgatttttgatttaattataagctcatgtgttactagattaataataaaaaaaagtcacatgcagtgattacagtgttaaaataatcaacttttattactaatatttatgcgtcataattaaattgtttttattttcagggcccatgcagagcactactggctgatctctccggcggaaaatccggcaggatgagaacagcaaatgcatttttctcatttttcatggccgtcggaaacattctggggtacgccgccggttcatattctcgcctattcaaagtattccccttctcaaaaaccaaagcctgcgatatgtactgtgcaaatctgaagagttgtttcttcatcgctatattccttttactcagtttaacaactttagccttaactttagtccgtgaaaacgaactcccggagaaagaagagctagaaatcgacgagaaattatccggtgccggaaaatcgaaagtaccgtttttcggtgaaatttttggggctttgaaagatttacctagacccatgtggattcttctattagtaacctgtttgaactggattgcgtggtttccctttttcttatacgacacagattggatggctaaggaggttttcggtggacaagtcggtgatgcgaaactgtacgatttgggtgtacgcgctggtgcattaggattactgttgcaatctgttgttctagggtttatgtcacttggggttgaatttttagggaagaagatcggtggtgctaagagactatgggggattttgaacttcgttttagctatttgcttagctatgactattttggtaaccaaaatggccgagaaatctcgccggcacgacgccgccggtacactcatgggcccgacgcctggtgttaaaatcggtgccttgcttctctttgccgcccttggtattcctcttgcggtgagtttctttccatttattattacgataaataaaatttggtattcctcttgcggtgagtttctttccatttattattacgataaataaaattttagatagtcaattaactgagttaataaaatattttttttacaaaaaatttaacatttatatttagtatgtgtgaacatatattacaggtgggttgactcataagtccaaatatgacaaagagatttattatgattttttagaattttggtttttttaggttggtggaaaatttatattatatggataagcaaagtgtgaaaatattgaccaaatatgactataacaaacacaaattatttgttagttatatacatgacatcctcttcatatataggcatgtaaaattaattaaatgtttttctttgtctttgactatatttgaaagtaaaaattatatatcatttttgaaattgaaattggatatttagttacatcttttttaaaatagcaattaggatgaacaatagccacatgtatgttttcaatggataattattattttattttttttgaagaaaatttaaaggagagtataggtttatggctttttaccaataaaataagaatcatgatatgtatgtgggctttgtaaaaggtttgtaaagtcacacacataaatgtagaaggtgtgagaagctttttaattaatgcatcacatgactttttagttttgttaatttctagttatttaaattaataattattttagaataaataattttaataaacatgacaattaaaaagaatcgactattatttctctttatcctaacataaggattaggagaatcttattactttttgattaggataataatacaagtttctatgcaaaatcatcttttattattattattatggcaaaagcatatattctctcttttcttcctttaaattattcttttaagatagaattatttcactttgatgttagattttccctttttatcttttttgaaattgatcatgtttttttactaatatatgaaataaaaataatttgattttacaggtaacttttagtattccatttgctttggcatctatattttctagtaatgctggctcaggacaaggtttgtcactaggagtgctcaatcttgcaattgttgtaccacaggtactatttaatttttaattcctcaatcatggataacgtacttaattcttctttttaattatcttactttcataattaatgcacaatatatttaaaccacaaacgtgtaatctaaatagtgaaaaaatatataaatgctagtctattacgtgtatataactgttatagatcgaatttatgtacgaaaacattacaatcaaagcaattgtagtatcgttttcaaactattgacagtcttgtagttaactaattaaatttagaatatccatcctacaacgcaagttaaaaacactcgtaaatccggacacatgttgtaggattaggggtagatgttttcgaggctattaatagtgtagagataaaagttttggagtgttttcaatacatctgtcttgttagaaaaaggtcgaggcccacgttaaccggccattgtcacctagacccctacaataaaaaaagaaaaagaagaagaacgtataaataggggaagatcataactgaaggaatttgaaaatgacatgtaactagaactacattaatgagatatgaccacaagatataatcttatgactatacttcttattattcacattaggataaactaacatactattattgatattaaattagttttaaatacacaatgtacctaactataactacttgtttttttttttatgatatagatgttggtgtcactagtaggagggccctgggatgatttgtttggaggaggaaacttgcctggatttgtagttggagcagttgcagctgccgcgagcggtgttttagcactcacaatgttgccatcaccacctgctgatgctaaaccagcagtcgccatgggcggtttccattaaaaaaaattacaaaagacgaggaagaagaagaaggagaagaaacaaactttttttttatatattagtacttctcttttgtaaacttttagaaaacaaacataacatggaggctatcatgtccatgtatcttcctttttttttcttttcataaagctctttagtggaagaagaattagaggaagtttcctttttaatttcttccaaacaaatggggtatgtgtagttgttttcaatttgtgtgtaacaaagaaagttgtccagtattaacatgtctgggcaaatgctttgtacccttttactatttttatttttatttttggtaattttcttcttggaaggtaggaaaaaaaaagaagtggttggaggtggaagtggggtactttaatttgggttggtaagaaggggagatttatgaaaaactttgtacttaaagtggaatcaaaattgatctatctatatatctatcaatgttttctatttttttgtttcttgtttcaaccattatttgaactttttggtggattgatagcactattcttaccttatttagtggtatgcatcttctagcacttcccaaactttgaagtattaattaataacaacattaatttgtaatatacttgtattatattgagtggtggagctacgatactaaagttagtctactatgctctcaaagagttgttaccagtgagatttgaacacataaatactttatatttgtgctaataacctggtttggaagcaacaaatcataggagcgtagtttcttttgtgcttcggggaagaggctgctcagctcctataaaagctaattttgattggtatcattcaaatgcaaatataggcctagtctcattgctcttttaagacgcttgaaacaattgagttacatcatattcttatgtcaagaatgtcccaaatatgaaattactttagttattgtattacttgtatataatgtataatttttcgacaaagggtctataattgaacatcagtgcaactacgcccctaataaactattggaaatttgtgtttgttttaccatcctaaatactagtgcactaattggaataagttatatataaatattttggaataatattttctattcattacaaaattaaaaacaaaaaataacaaggttttttaaaacacttatttgaacaaaatttcatgcgtaaattgaaagggaattttacttgagataaataggatttgggagttgaacttccttttctatatcattgtttctatttttctt

SEQ ID NO: 494 - DNA, 4860 bp, Solanum lycopersicum
gcaaaatagttaggtttacctgcaagcttttggagtagataaagagagtaggatgatgtaatttcttcttcttgtttaaaaaaaaagagagtgatgtgccagaagacaactgagccaatcagaatggaggttgagaatttgattatggtgaaatccacccccatctcaccgaaaaacaaaactgcaactctttctctatcgctagttggtgttgtcacagaaacagttctcagaagagatgacattgttgatgatatattctgttggtggcgtttgtttgactcaattgattcgatgctatgtgaaatatgtctttccatctttcctttgtttggacagttattatgtgctttatggttaacggtaatctttcatacaggtgacccctgaagtccactttgagaaggatttgggcttagacagcttagatacggtagagattgtaatggctctggaggaagagttcaaactggagattccagacaaggaagctgtgaggatagagtcatgcgaacaggctattgagtatgtttataatcatccaatgtcgagttaaactcggtacaccacattgttagtttgaatttgttcatcaaaatcgaaggtacacttgccccttgtcatttgactagtttcaaggttgtagaattctgtgatcctctttgggttttggagaggcaataatcagactcttataaagacaagtcgagcaagcttttcagtgaaagaacatatcatcctttgttgctttccttgaaaacacgaacttaagtgttcattttgttgctgtctttcctctttaaaatattttatttttacatgctacagtatttcaagcttgcttccagtgcactgatttcaagaatctatccaggttacctgtagaggtgatggtaacactgaaatttctccggctcgttacgagtgtaagcaaaagagcaggtcgagtcgatcaaaaatgagttaaataaaaataaattaaatactcaactcgacttatatgggtaaaaacaagtttctcgggtatccgtacaccaaattttataaacactattctttatttaatcaaattctaattcactgcctcaaattttacaccaaaaaaaaaaattctccctcttcattattatactattgtttctcctttcatttatattttcttataaatatatttcataaaacaatttttttctaaaacactcaacatatataattcatgttatttccttttataatcgtttaataaaaaattattatgtgacataattttcgaaataatatacttgctagcaaatattatacattatacataataatagataaaacgaataaaagtgaaatcttattgaaatacaattaaataaacgttacataattgaaaaaattattttaaattttacataaatattgtgatgattttagttttatgtatattgtgataatttttatatggtttcatctaatcccccaattaataatagtttctacgtcaagtttaatgtgcttgtgattctatgtctgtagatatgtttgtgggctactacgcacggctagaatactttacgttgttgtcatcagatcttctcaactctgctttttctatttctccatatagcttctgaatttttgaatttttttttcgaggaaaagagtcaaaaatatctctcaattttattttattgtttaactatatccttaccgttaaaataaagttatttttgcccctatcgttattaatttcaccataaatacctttcatttgatggaaagccataaatcaactcagattaacccgatttcaattaaaattactcgattttatcttttcaatccaaacccagcttccattaaaaaatgtaattatataaataatatgcatacatcaatcacatagagcggcacaatcatcttaaaaataatatataagcaacatatgtgtatatatacgaacggactttaactaatttgcagcctaataatatttgtgacatttatcgtttaatatatatcgggcccgtgcttgtatgggcaacattttctagacaaataaaatcaaaagcacaaaagaataagaacattgaaacaggaagaacactacgtaaagattcgtatataattttagagaattattttaaagaatagttgattaacattatattgattttcttgaactaataaatttttataaaattatatgcatttgaaagtttattacaacatttaatcataaaaatttaaatataaagaaaatatggagatgtgcaaattataatatagcaccttaggatattcagtatctcttatttatgagctatatatgtgctatgatttgcttatttaataagaattaatttttttttacaattttcataattgtgaaatttttatgtttatacaaaataaatataaaataatttataaaattaaattacatatttaaataaaattttaacttaggatcaatgatagcgagaaatttaacttttaatagcaacattacttttttgtttttcaaccatccaacgtggttcgttctccccactctggaatagggatggcaatagggagatgtagggtagaggcgatatgaattgcgtttaacctgtaaaatttttaataattaaaatccaaattatacatagtaagtctaccaaacattaaaaaaaataaaaaaatagaattatggaaagaatggagaatttttaaccaaactaagtcattatataaaataatgtatcaaagtaatacatttttctaaaattttacaaaattagtataaacgtatttcacggtaacatttttaggatatattttattttttaaaaactaacagcattaggttgatatacgttactgtgagtaacgtatatcaatctgacgccatcaacttttaaaaaataaaatatatcctacaacgttaatgtagaatacgtttatactagttttgtaaaattttagaaaaacatatgctttcccatgctctatttcttcccccttcaaaactataaatatatatatatatagcaaattaaagttcatgtcaaaaacatgaagcatttttcctgtttctctctttatttaacctaacattctatggctccacagcccagaatttgatccaaccaacttcatcgctacaagctgctccggcgagtcaacgtgctactctccctggcattggaatgacttcaattagattagttcaatacaatgttagtgatacgatgagtcacgttaagatgctactattgaaggataagcaattggattctcataatacgagttgcttgaaggcttgtttagaggtttattccaacgcgatcgcaagtatcaagcatgctacgaagagttataatacgaagcaatattatgatgcgaatatacaaataagtgcagttatagctgacgctacgacatgtgaagatgggtttatggagaaacaaggtggtgtctcaccgttaactaagagaaatgacaatactattcaattatcttccgtcgcactttctgttgtgaactttatgttttacaatagatcaatggaattcaaattaacacgttaatgtcatatgtataatatgatctttgaattacaacactttatggattttgattgagttggatctgatgggaaccgaaacctttgttagttaccgattcgagtatgtttgtggtgcaatgactgaggttgtttatttcgtaatagtttctctttccagctcaaaataagttgtgtaatgttatatatcgtttataatcctcccctcctcacattgctagtcgatttaattatgaaacgttcaaaaaatctgattaaatgtaaggttgaaaaaattgctaagagaaataatttttctttacgtaggcaagcgagagagaagcagagcgtggtgcttttgctctaaaagggttcaaatttccacccatatcagctcgatctatttatttgggtcttaaagattcatatgtttatttgtccaactttatacaagtttaagtatctatttatacacatgcaaaattaaaggacataaatttgaaattaaaataagttaaaaggtacatttattattatgtcattaaaaagtgttaaaacttgtttgagacgtaaaaaataattttgtaaaattagagtttaaaaaaatgacatgtataaaccttttttttaacgacgaaagagataaataagtctctctaaaagcacgatgacatatttaagacttctcatattaattaaatcattgatacaaatagtatgtatagtttggtataccgaaaataatgggcaaataatttactgttgcgactaaaaggtcaataagctagggagtaggaagtagatgtagaaagtttccactactttatctaactaagattttgtgttttttcttaatagtttccactactttatctaactaagattttgtgtcgatgtgggacttttgtcattctttatctactttatctcagcatccggtgcatgggcaatttttaattttggggaccccaacatcgagtgagacgggccctgctctgataccatgtgaaattaggtcgtaggcctaactcacaccccaaaaactagctcaaagggaggaggattgctcaagcctctcattaatcaccgatgtgaaacttttgttattctttaacagatagacttctgataattttattcgttgtaccatattttaaattaaattatatcaaaattctccttgatctatttaaataaacataaataaatatacgaagaaccaattcatccattattaattcttaagagaaagtgtcatagcagataattgaaaagtattttcatttaactttgttaatagtgacacaacaccatttttatcc

SEQ ID NO: 495 - DNA, 2625 bp, Solanum lycopersicum
tactctttttttttagctaaaattaaactagtatatacaaatatataaatgacgtgtggaattaacatttccattaaagttatagtaatgaatagaatgtgacaaataaaataagttttgggcttaattaagagtatatcaagagaaaatgacttctcaacagcttaagattgcaacaaatttatagaacaatatcttatgaataagtcataaaattaaatgtgaattaagaacaaaatcatgatgagccggttattccattccataaataaatcacacccttctccattactctataaacaaacaaaaaaaaacttataattaatagtatcaaattaacgaattaaaataaattcggataaataaaaaatgaattaaattaataaatattaaagtcattaatttattcaaacattacttgagctgagataaacaataagccttagctcaacttgtctaacttatactaagtaacgctttttttttctcgaaaatgcacaagtacctcccaatctatgccctaattccagagaccacatttatactatactaaggtcatattacccttctaaacttattttataaataattttctatcccttttgacctatgtggcactagcttgaaaaaaattgtcaacacgcgctaggcccacaagatagtgtctgtaggctgaaaaggagtagaaaattaattataaataagaccccagtataatataaatgtgtctgtgagatttcggatatagattggggatacttgtgtatttttctttttttttcttacctatgttttgacgaagtttttcataggttaatttagccgaaagttgaactgcagtctgaattaaacgaatcaaaagatgttgaggtaataaaattagggttaattattaacctagtccaaactttactagtcatgttttatataaacctattttgacacccttatagtttgctatagtctatttttccccttaaaaaactataatatataccccttgaacaagaaaatacatgtcataaacctaacaacaacaaaaatgaagcctcttttctctctcttccttactctttccctattcctctccttatttttccatggctcaaaaggccaaaatttaatccaaaacacttgtaaatcatgtgcaaatgatgatccaaatattaagtatggcttttgcacttcatctctacaagcagctcctgcgagtcaatgtgctactctccgtggccttggtatgatttcgattagattaattcgatataatgttactgatacgaggtgtcacgttaagatattattgaaggaacaaaaattggatccttatgttaagagttgcttgagtgattgtttggagctttatacagacgcgattccatctatcaagcttgctatgaagagttataattcgaagaaatattatgatgcgaatatacaaataagttcggttatggatgccgctacaacatgtgaagatggatttaaggacaaagatggtgttgtgtcaccattaacaaagttaaatgaaaatacttttcaattatctgccatggcactttctcttatgaatcttattaagaataataatactaatgggtaaatttttcaaatgttgatattcatctttttttaatttttattacttgattttaatttgtagtgttttcttagtctttgcttggacttctttactaattgaatatatatatggatttttacctttagtttaatttggaaaatacacttagctaaccttggtaaatttattcattttcctttgttttaaagtattgatcctcacacccacctaagaattagatattacacattaaactatgatatattggtctccaaactatacctcagatagataaaagtatatcccgaaattagttattctttatcttttgtgtaccaaacaagcgcttagatgtttttatttgtcaccgatattatgtttgttactgaaagcatttctttagacatgcttcaattttggtgatatgaatttccatcaattatagaacgtcaaatttaaatgtagatatggatttgtttttttctaaaaagaaaaagtataggcagtgattgactaatcactaatttctaggcatcatactgttgtatacttttcctattttaatttaaatcttatagtaaaaatttttaatttaaatcttatagtaaaaattttgagatatctcaaatatattaaaatattttttaattttataatcttaaatttataaaaattagaattaaaaatttgtttaaaaagccttgccaaaaatcggcacattccaaatatacttaaattattataactttggtaagtagctgttaaatagaaatatttgtaatcttcaataatagctcttagaagaaaacgttaaatgtaaagacaagtaggtagatgttttcacttctaattatttataataataatctataccagctagtcaaattgaaataataataattataggtggacaaaatttgtagaaaataatttcaaaacacaccaaatctgacccatattccgtcttaaataattaaaaaaagagagtatataatagcttcacaacttcaaaaataatgggcacaaaattaaatatttacatg

SEQ ID NO: 496 - DNA, 4044 bp, Solanum lycopersicum
agcttctcacactccaagtccttgttgcccttctcttcaacgcatctaatcattcattacaagtcaaatataaaaacttatcaaaagtgtaattaacagcaaaaaaaataaataaataattctactttttttcttcttctattaatggatataatcataattaacattgtaggtaagagagggaacaaacttaaggtagctgtgaaaacaagcataacaacggcgaatttcatcagcaattgcattagctttagctttctcttccgtttcaaactgcaatctcacatccacaaattcatcactcaataaacacagatcaatagaacatattagtagtagggcactcggcccatagaaattattaaatttgaattcaaaattttgatttcaaatcaacaattgattatgaaatctgtacaaaatctcaatttcaaaaatattgaaatatacagagttttcaagtggagaccaggtgatcagttgaggaaggaggcggcggcttagaaacagtgccaaattcatgaacagggcgaggtgcttgttcgcctttggctactttattaacatctctactcctcattttgtcatgtggatctacttgagctgatgacattttttttttcactataaacacacacaaaaactccaatttcttcttattcttcttcctcttttttggtgtttgtaaattaatttgatatgagcagagagagaggtgagtacgtactgaagaaagaaacagagtgaatactgacataatgctatcaagtttacagaagacacgtaccaaatatgtaaatgaaacgtgtcacatcacactgctaaggtttggcatgtcattgtgattatgatgattaagaagttagtttttaaaatatttgaatattaagtgattaagattattatataattatatatttttgttcgttagtgatagtgggattgatataatgggttacgatgatttatgatgatggagatggttgatactgtaataattgttatgacttgtgataatgacgattgatagtgatagtggttatgatgataaagttggtcgatgttaatagttaagagtgttaatgacgatggccgagggatatgtggtgtttaatgatgtattgacatgataaattgcgacgatgctagttgtgatggtgaaaatgattgacaatatataaggattatcgtagtaatgttgaagatgacgatgataataatgactgacgatttgttagttctagttatcggtggtactggtgttggttggtaatatggattgaccgcagtagcggtaggtgtgatttataatgatggtagagccggcaatgttaatggtaattaatattaatataattataatgatgaaggaaaggtatggtagttgttgacactattgagagtgatggtggttgtcagtgatgattgtgatgacataggttactggcggtgaatgaggataataatataggtggttaatatggtgattggtgatgttattcactccccttctaactaaatgtcttaacttttatagcttaacttgctaatgttctagggtttttgttttttcttttggagggaggagagggggggatccaaattttgaagtgaaatttcctaaacctttgtcacatttgctccattcatttgatttgtttttgggaaatttcctcatggtgttaactatccattctgtaattctgtacaatgtatataaatatcatttcacaatacacagaagaaaatcatcaaaacattaagctcagaataatgtggcattgcccttcctcttccctctcactttgctgcttattcttactgttaacaataacaccaacacattgttacctgatttccccagactggataaactcaacctgcaaagtatgctcagataaatcagcacatacaaaactacaacttctgtgttacttcactccaagcaattcctataactcatgttaccaacttacaaggagtaggaactgtagcagtggagctggctctacaaaatgctaccaacacgattttgaccattgagaagatgctcagtagcaaagagtttggtccttttgctatgaactgtttaagagattgcttggaactttatgcagatgctattaccatgctggtggatgcttttgtcgcgttcttggctgagcattttgatatagctactgtactaatgaggacagttatggatgcaacatcaacgtgtgatgaagagttcactgagaagaaaggagaatcgacagtactagcaaaggagaattacaatctcttccaattgagtgacatctcatcgtgcatcattaaacaagtttcctctgttccttctcagctaagtcatgtatctccttaagatgtggctgctataaattgtgtactgaatgggacaccaaagggttgctaaattcttgtagaaatacttatcaacaagtcttgttatccccatcccccttttccttttcccctgacgaggatatttgcacatcaaagttgaaaacacacacattagaggtcaattaacaagagaactgggacgaacacaagataaatagtaacaaaaaaaagagcaatatataatcaagtgttaagatccatttagttaaaggtgagatttgtcacttcaaaggccctccccgaactgtttctgaaaacccatctccatccccttagacctcgcgttacaatgtgctagcttcataaatttctgtctagattgttcagaataggcagctcttagctgctttctcagcaatcgtgtgccgtcaaggaaggagaattaccagtacttgcaagccacagctgattgtcatgatttatcaagacatgaactggtggaacctttgataaagcaaggttcagtaggtataaattatactgctgaataaaacatacagttatgggaaacaaagtgcacgattttgttagcaagaaactttagtcaacacagaagtaaatgtaactggagagtatatgattatacaacaccctcactgtttaaaccaataataaacttgctagtccattaagacaaacatacacagaacatttcaaaaatgttacattacaaatattatgtttgtatggcataacgtaaagctgggtgttctgggatgctcatgaagatatatttatctaatgaatatctatgaactccctaatacttgaatgaactagaataaatcttttgtacgtaaacggacatgataacgaaccaagggaaggggtggaaatttcctttccccttctcaattttatctaagaagcagtgcaccaaccaagcatttgagattatgacaacaaaatttgaagtcgggcacatgtactgatcagttggtactcgcaaatttgcatttctttccatgatttggggataaccacatccaaacaaataaagatttaagaagagaaaaaatagtagataattatcaatcagctaagcctgaaatgttctctttaattgagtgggacagaagataactacgcagttggcactagtagaatgcttaaaaagaaacaatcatgttcattgtccagtatgttttttgattgttgcccatcgtctagtataacttctttgatacatgtttttttatagcactgcatttgatgcaaaacaggaattatcatttttaccacactaattaaacttgctggaaatatgatttctcaaaattgttgacaccataccctaagaaaaaggagaaaatctgaactctactgttccagttgagttcttttctgataaaagtgtggattaatcatctcttttaatagtgatttaggaaattaggtaaaacatatgataaaaacgcattgttgcattacttactaataaccaggtaaagacatctgcctaaaaatgaacgcagtatcataaactttctgcttatatgtaattgtttcagcttgaaattatctaaccatgacatgtcatgtgctttcctcctctcagaaatatgcatagctgagagttattcaactaaacctagatctgctaatcctgcaagctgacctagattaataggctcttca

SEQ ID NO: 497 - DNA, 14370 bp, Solanum lycopersicum
acttacggtggttccttccttaaccttcttcattcctgcggaggcagccacctttgttttctccattcctctttcaaatttatcactcactcttttcgatagcttcggctgatcgcccagcgtctttgaattctcgatgctaccccatggattactcatatttaatttgtgaataattattgtttttttcacaaatcaacaatcaccagaagagaaaaaaagttccttttttgtattgtttttatgaggaatggacaagcttttgtttaggtttgccttacaatatatagtcaactaaaatgtatggagaaatggatggcttatgttttccaatattggtatccctgcacttctcaacataatgttattattaatatctttaaaagaattaagatttatatttgttacattagtttttggtatatagtattcttttttcgttttatataatataaaggtatcatttgacttgatacgatgtgaaagaaaaaacaaaaaaagttataaaatttgtaaattaggacaatttctgaatatttgtgttgttctgtattatttcatcaaagagtaaaaaaatttatgtaacataaccttttttgcatgaaataaaaatgataaaagatagaccgaggaattatttatttattctttttttttgccgtagttttcgggtatcattttgtgaacccaattagctgtattcatcgaatcccgctatttcaaggtgggtgcaccacgattaatttcacgggacgcgatcgatttataatgcctccaacggccctgctggggctcgaactgacgaccttaatagcaaggttcatctcaacttcagttcatattgacttgacatactaattagaaaaataattttgtatataagtatttaatattaatgacaaaataattaaaagaattatattttcttgataggttaaaacggactattttaatgacaaaataattaaaaaatgatatattcttgatttttctggtgtaacagtttgtcgtggacgccaccaactcggtgcctcatttgtttattccttgatagtactttagatatacttctcgttctccgcccatcatcctcactctccttctatccctcaatatcgtaatcgagatcctgcatctgcgtgtccccaaaatggcaggtaatatttaactacgccgctcattcttctaattgctgattgttttctattgaagatgaccttttgattgtagttgatcaattgttttctgtcgccttgaattttgtcgattatgatgaatagcgcacacagaattagtctagtttagtcagtaaaggtgtagtttcagtataagtgggatgatttcgggctctctcaacttctccacgggtcaaagttcgggtggtactatcaaagtaagagttgtatgataactcaagtcatattactgaaaattttagcctgctgtaaaaaaatcataactttttactatggactcaaattcacgaacacgaacacttggtagagttggaaaaaagacttaaatatctttaatttggtgaatattgagacacataatgataagttgtatgcttgcttgaagttgatcattggatgatcttatgcaaaaacttaatcggttggggaactttgaactcaatttagtgctagagatttcttgtgaccttgattcacatcaaatatacttaccacacttaggaattgatattaacacctatgtacaattatatatcatagggttctgaccctatacatatacaaatactggttcgtatcttatcttagaattcttggggtgttgtagtttgctaaataacatataaatgtttttgggatactaatttttcttgtttacttaccaaacactagaaaataaataagaaacccacttgttttctaagaaatctttttctaggaaatcattttcggttgaaaatattttccttcataccaaacacatcctagttcctacataaaaattggagaaggtacgaagttgttagggccagggatagagatgacaatctggctgggaggtagaggacaattaaattttacaatattaagggtcttttagtattctttattccttatgttcatacataatagtggacgtcaaccaatatttatcattttaaatggaaatttacttttttccttcaaatgatataggaacgcatgtaagggaaaacacaatacagtacttgatgataatctggcataatagggtggaacgggcatcaccacggtagaaatcatattgggggcaacctaggcgatctgtgtaaggcttcctatgttctgcatgtctgatatcgtctttaggatattatttaagttgcgcgaactcttcaatttcgatgccgcacccgttttggattcttccaagatgcactacttttggagaattcaacatgcatctattgacgattttgaagagtccgagcaacataggatattattacaacaacaacatatccagtgaaatcccacaagtggagtccaggtaaggtagagtgtacgtagatcttaccactatctcgtgggggtagataggctatttttgaaagaccctaagctcgagtgaagcaaatccaagtaaaaaaaagaaagaaaacaatgtagaaaacatagcaactaacaaggaaatcagtgcaaagcctataagaaaggaacaagaacaacaaaatagtgatataatcgaaatacactaatcaacagacgatgatcaatatcaaaagaaaaaactacaataatccggctagtacaatgacaaacaccaacaagtctaaatccttcgaaaagcaagacaacattcccctacctactaatcttctaccctagtatacatccacggcaccctcctatctaaggtcatgtcctcggtaatctgaagtcacgccatgtcttatctaatcacctctcctcaatacatttttgatctacctctacctctcctcgtaccgaccataatcaacctcttgtgccttctcaccgggatatctgcatatctcctcttcaaatgtacgaaccatcttaatatatatttctccagctaactgctttttgaaagtatttagtttttccttcatttccacctcctacttttgcttttggctggtgaactattgtgtacttgctgcttgactgactaaatagtattcccaggtagaaatttcttgggtaactcattttcgttgctatttttattggattaactaggttatagcaataggtatatagatatgagcatcgctaggtaaaaatggaataggtctgaaatatttgggcagttagagtaagacgaagaggtatcaaaacatgatggcttcagaatgaagttgactcaagattttatagaccatgcacagcaaatgtaacaagatttttatttttttgagatgctgtgatctattaattgagaccttatcaatctctacttcaataatgcttgaaatctttaatcatgcagcaatatcagggaaggttgtccaacataacctggtagcaaagtgctgccagcaggatagggaattgagcacaaaataccgattgtactattgtacccttagtaggcgcaacttgctcccccctgtaggagggaagttggcatggaatggcaactccaccatgcaactggatgccttatcaaaatctaagcgaggaaatgtttattgcaatggtctgttctagaatcttactgttcaggttgatctcagattaaaccataactttcaaaaatgtttagcatacctaattgttcagtgacactcctttcagtgcttattttttttcttaaattggtaatcttttgatttatccacaacaagtgtacctttctctagttatcattaactaattttttgagtcataaccatgagtaatctctctgattgcatcataactaaccatgttgtatatcctgaataatgctaaaaacatggatctttgtgcagctgcctcgtcgtccactgcaatcccgtctgttgagaaaagcaactttcttaagcttcagaatggaaggtacttgtttcttgctaattcaacttgccatctttttaaggtggatagtttatcatgcttctggcttcctttgataagtttcaaaattggttaattttatggatagtaatattcaattgttttgcgatagattggtgaaaaagataaatggatgagttttcattctgtacagcaattgaatgggcaagtatggtagaaaaagagaggatgatgcaacaatagcgattgtttttctcttttatttttttgcttctccatagcttgaaacttgattagcgaaaaaggtactacatgatatggaagcagtgaatctcttattctaaaaaagtaagtgaattggtgagtgtagaagaaaaaaagaggaaaataaaaaaacccagctgatattcctttttttggtttaatgtttaatagcctggtgttgtcagtgttgatacatctgttatggttagtagagaatcagatcatgcttagctaatcatttacatattctcgatgcaggtaaagtttttgctaactgaagtttcttcatttaaaacttttttgccgtaaccttgaaagaatggtggtctaaacatgtatttaagataaatgtgaattcctgttgatctttagctccctgtggttgactcttaacattagcttttctataaatatctaccttttctttgtttttatcatttgactgtaaatctttaaggtttgcttgctatacgatgttctactatattttccatttgataattgtaccagaaacttaacatgacacagttttttgagaacttaaaagacacgttcatcaaatatcatctttaatatgattttcaagagacatctttaatatagaatccatctaagataaccttctatgcaagaccatgatacccatccatatatgacgtaggcatgtagctaacaaacagttattcataagttccaatctgatttattcctctgtattaacccagtgatatacgtggagtagctattgatggagttgagggggaacctcttactctcacagagacagttacagaagcaatagcagcaggtttttctggttggttgctggcaaaaaagaaaaatgtttcttctaaatgtttaagagtctccgtcggtcatgactcacgaatttctgcacagaagttacaggtactaaccctatataagaaagttaagctgtgtacactttcttaatcagcaatttcagccttaagcagaaatgtctttgtttgcttcttttctggttaacatgactagagttaatgctaatggtgtggacagcatgatagattttattagtactacacacagtttgtagttgggctgtacataccaaccaacataggcttaccactgtatgttaagtcaaaacagaagaatttacccagagataatgaaaaaaaatcaaaatgaaaatatttcctgttctagagtgttgtagccgttaaggacttcttagttcatcatcctctctcttgtacttctgtgctttattctttcattcacgaggtacattgctgtctagttgattaaccctggattgctatctgtcaggatgcagtttctcgaggacttgctagagctggagttgaagtcatccaatatgggttggtgatgcttttcttaggtcctatttgtaactaatatgtgcagactccgactacagattcttcgctcatctaacccataacctataaagaatggaatttaatcattttaaggtgatatatggttctatgttctgctggttgctgtaaggcctactgtatagacctttttaatatgaagactgaaaagcaaattattatttcaaagagatctaagaagtctgaacattctccccctcccccacccaaagataaatcattaattcattatgaatcttcatatctgcccttatcaaataagaaacttcatatatgtcagcaccaatgaccattcactagagatttacgcaacaatttggagatttgacaaatggtttcaatcaatctgttgttggttaggaatttctgcatgagtagtgaatactagctaatcatttctaaagttgattatagttctctaaaggagtcttatggatatgattggttgaaatatcttgggttgatacaactgtaaccagatatttggtccttaatatacaacacaatgctgaataatgccatcaaagacatagcttgatttaaatctgtacaacgacaacttgcttcgttcccaccccaccatttctcataggattcggaatacgaaaatttttgtttgcacttccgattaagatgtctagaaaatgttgttgtaagatttgtttttgtaaattaattagcacgattttaggagacattctttttccttagcataatgataggaatatattttcttttatatttcaattgattgtgtttccgtaattagttataggtttcatggtataaatgccccttcgcaggagatcttaggatatactcaatacaaagaaactttctcttctttctccagatctatatgttatcaaagccatttcttccttttgaggtgaggtttttctgccttgtggcactagggttcctttttctcaaaatgaggttgagttttctcaaaaagaggttgagttttcttctacgcttacttccagatctcttgaaagaaactgtatgacaggttgctagccagtagaatcagctattgaaaagcaatcacaagtaactaaccagagataaagttaaagagtcagttgataagaagagatattggttggaggattcatttctctctctcactagattagacacagcctattcaatcagcttgatgagtcaattcatgcatgatccccaagatccttatggtgctagctgctagctagctatctttcacatttttcggtatctaaagtctacaccagggaaaagtttgcttttctctaaacatggtcacctcacgattgaagcttttacatacacagattgggcatagctgacaaaagatgtatgtctgattactgtacacttgtaggagggaatctaaattatttggagaagcaagaaacaacatataattgccagatctagtgtggaagcaaaatatacagctatgggcagggtgtttgtaagcttctttggctacaaaagttactggaagaactgagattgtctgaaaaagggagaatttcatactttatttttttttaaaaaaagggagactttcctagtactgcagcaacaaagctggaattagtatagctcggtactttttttattttttttgtgatgactagtatagctcagaattctgttcaacttgactgaacaaaacattgaaatttatcggcacttaatcaaagagaaagctactagtggtatcttgagtttgctttatgtaatgtcagaaaaaacaactagttgatgtgctttaagaggcagaaaaagagctttccatactttttgtaagttgggcatgtgggacatccttgctccaacttgagggtggatggtggtgttgattgtgttaattaaattagcatgattttaggaaaaatcttttttcctagtgtaattatacaacaacatacccagtatagtccaacaaagttgggtctggtaagggtagagcctagcctaattataggaatataatattttctttttattgttgttgactgtattttcttaattagttgtaggattcattgtataagttcttatggaatgtaaagacattgcaatgcaaggaagctttattttctttcctaatatctacaaaattgaagagagatatgtgcatatcatctttctttggtttaaattgtttattctatgtcattcaagtgatgacatgcctaatgagcctttctctgtccccccccccccccctcctcttcctcttatcccccatggtagattggcatccactccagccatgttcaatagcactcttaccgaaaatgaagaattttcctgtccagtggatggttccataatgataacaggtgagtgcatgaatttgttatctagtatgaattgggatgtaaattcaataataattctatctttggacgtgtgaattttttaaagcatctattatttgcaagtgggggatggcctgctgcttctcttgtatggcagcttggttcatggttggagttaatacagtttgatattaatagaattggcttagtgctggttggatgattcttttgtatgataattttgtttgccaacagcaagccatcttccctacaacaggaatgggttcaagttctttacaagtgcaggtggacttgggaagcctgacatcaaagatatcttggagcgagctgctgatatatacaaaaatattgcaaatgaaaattctaagggagcagaaacagctgcttctctcgatgtgaaaagagtggattacatgtctgtttatgcatctaatcttgtagcagcagtccgcaaagctgcaggaagtataggtacttttaccatgtttctgtattaatgaaaataatcattgtttcgaggaaatggatgcaaatcataaaattaatttgtgatggcacgccaatcatactgggaacttccagggtggtattgacctgcgattaagaatctccctgtttaaagagtttcgtatacttccaatctaatgaaatatcccaaccgttttcagagaattcaccttaattgtttctctgacccagtgttgttcagcctcttgttagtgctcattcactttttttttctctttcctttttttgtggttcaattctcagaaaagccactggaaggattccatatcattgttgatgcagggaatggagcaggcggattctttgtggtaagtttttagccttgttgcgcgctttgacagttttcaccttccatacattgcatgaaaaccttctgaaccaagaaaaacacttaactatagcttaaaagaaaaaccaagaagaaaaagatgtgtgtgtgctattaatagggctgggtctatttccataacctaacatacttatcaacacctttttattttatcaatttccacgacagccttaccaggatatattggtctccacccacctccatagtccaatctcacatcaccggtcaggtctttcaccattatcgttgtcagattcaatggttttgatatctttaggaatatagagcaacttagtgatctgacaacctccttttgattagttaatcatacaacaatgtctcatcctaccaaagttgcgaagggaaggagcggttggatgatgtgtaaactggaccccaagattaaaaaaatatatgaactccattgtgtatcctctgttactatcaagggaaagaaacagtaggaccttttgaaggagtgaataattcaattaagagtaaaagatggtatctgttgtacttgtatttgtaatgtgacaaagaaattccatgttgtatagatggatgattagacttttgagatgtctagtacacagttgtaactaaataacttagtacagtcatattcatcttggtctacaatattaagaaaagatattttaggaattatcttttgatgcagttaccattgtctgtctctgcattcagatatgtagattttaggagcttctaggagttatgaaagatgaggaattacagttgggggtactggggaatgaacagaaaaaaacaaggagtagagaaaagctagtaatacatgattgaaattttttaaatactttgaattgccaaaagaaattgatattctctcttttgctgtcatgccaacgtgatcccactttcctgaactataaatctttccttactctatatactttttttaatacctgcaaaacttaaatgcaaactgcatatcatactccaaaatttatcaaattatcagctttatgtcttccattaggtccactttctttgaaatacattataagttagctcttgagatccgtactagcctgttaagtcaaactaagatggttacacaagaaaggatatgtttttatttgatacattgtctttcaattctagtcgatgtgtaagggactaaaatgcatcaatagttgttatcaattgaagttgttctaggggaaacgaaactcaaggaccatctaaaaggtctttaagacatattgaaatctgtttatcagcttaatttgtaacttaaaattttctcagggtatatcacttttaccttttttccctttgttgttctttttagatgctttggtcatattcttattttactggattttcaggggaaggtgcttgagcctctgggtgctattacttctggcagtcagttcttggagccagatggtaagatataacctgcaattttcacatacagatttttctgtgactcttactaattatttgattctcatgctaggtttgtttcccaatcatatacctaacccagaggataagacagccatgaaagctattaccaaggcagtacttgataacagggctgatttgggaatcatctttgatacagatgttgacaggtgatgtagtatacaagtcttttcttttaatggacgtagtcatttgttggttcccttttctgatatatgttctggtcaggtctgcggctgtggattcgagtggtcgtgaatttaacagaaatcgtttgattgctttaatgtccgcaattgttttggaggaagtgagtatctctttttgacaagtgtctctagaactcttctctaacaagcatcttaaccttttactacttctgttaatgtttgaccagcatcctgggaccactattgtcacagacagtgtaacatcagatgggctgacaacatttattgaaaagaaactaggtcagatgaggagtcaaagtcacctgtgatacccttgttatgagaatggatgctaattttaacaatattattgcaggagggaagcatcataggttcaaaagaggatacaagaatgttattgatgaggctattcgtctggtatgatttggctatttgatgcatggttctgatggtagcatttcaatggtccttttgtctttataagcatattagcacatccatcataagatggatcttatctttgtctttttgggttgcctccaattgcccagtctcagataacaacatgatgtcttaaataaaatggttcgattcttttcatgtgcttgtggtcatcatgttatagctttcttttgttcacctttctccggtgaaagaaaatccatctctccaaaatatagtagttataggtatattttagcttaatccatatctgatgtccttcacatttcggattatgttgaataatctccaccaatcccccaaaaggaaaaagaactctctttcttgaaaaggtaacttaacatcctacctaatattctgaacactttattgctcaagaaagttgtatgagagcacttgtttctttgcaaactcttttgctttttagtaaagaaaaaggtgatctctgatccctgacctccattcggcatttgacaacttatctcaaactttaacgttctgtttataattcatggatttactagtttccaccaagaattggatgcgttgtgccaagtgttttaattaattctttaaccacacaaacacgtgactagttttattagagaaatgctttcatctgaactttctcttctattggaattattttaacttcgctcaccaggggtgatcaaggaatctgaaaattattgatccaggggagaagcagcaacccaaatttgtgggattttttctaaaattgagcgcactcttcaatataatcacaaactttcaggattgagcattgagacgaactggaatcctctgctatctattcatctttttctccatgagcttagcctagtatagtacattcaaacttgctgaacttatctgcttgaagaaactattgcctcaagctccacaactctgaaaaactagtatggcttaaaagatggcgtctgaatctggcgatttccaatttctttgcttttctagtattgcttcaaatctttgttgccaagctttaagtttctctgagacagattgtacttaatagtagcatattgacagaactctgttggtgaagaagcacatctggctattgaaactagtggacatggagctctcaaggagaatcattggcttgatgatggtgcataccttatggtacatgtctgccaatactaatctgtgggttctatgatttgtcttcagtacaagtcctaaaactcatttgttggttttcgtcacttgcaggtgaagttactgaataagcttgcatcagctagaacatcaggactaggcggaggaagcaaagtcttaactgacatggtggagggtcttgaagaaccagctgttgctgttgaacttagactaaagattgatcagaatcacccagatcttcaaggagggtatgctacaatgtccctcacaatttaatttggctgaggttattgaattttttgtaaattgaggaacacgcttgtgtctccagatccttccgtgattatggtgaagcagtgttaaagcaacttgagaatacagttgagttggatgcgaagcttctgaaagcacctgttaactatgaaggggtaagcttttaacgatttttgtccaagcagaagtagatgaggttattcttcttgatatcactgagttcttatcatagttccttcaaatgcatagcgagcggcaactgtttatggacgttatattttgtttgtttagtcatagtcattacatgtgttgaatcattatacgtatcctgctattggtcggaccttttactttcatttactaatatttagacatctgcacacatttatatttggagtattagtctaaagatcaattttgtctgatgacaggttagagtttctggatttggcgggtggttccttctaagactctcactacatgaccctgttctaccccttaatattgaggttgtaactattctttttaagctcttacaattttctgcaactacaataatctgatactagactatatgatcattttaggcaccaagcaaggaggatgctgtaaaacttgctcatgatgtgcttaatgctgtgaaagagttcactgctcttgatacctccgccttaactaagtttgtcggagtatgagtgtgcattgagtttatctgtcatcttgacgatcatcaaaatttggacgacttgacctcagtgccgctgacatgttggatctttgcaaattttgaacctctaccatagaaaagtgttttagtaaaaaacaaatcaagagctgtatgcaataaagttacagaatctgtctgtacagagaaaaagacaattgtggttgttttgtttatggtagtagttttggtgcatcatttacttcaagaggtgcagatgtccaatgactattacaattcaatagtgcaaaatgtagggactaattggcaaaccttaaagaagcatctacgtttatcttaagtaataaacaaaattatcctcatagaccctaaaaagtggttcaagattcattcacagtacaatggttttggatgattccacccattcctagcctgactccacctttcatgttcaatagtcccttgttggtcccatatgtaccccttttgtcactctcatttgttaaattttccactttttgccaacatggattgtgttgtcgtagtagattgtcctatccttaattagaagtttcgagttctattcaatggatatatagaaaaaaattctatttgaaaagcgactccaaaatgggctctgtggtatggataagtcgaggcttctactaaaattaaaaaaaaaagaattatgtaatatttaaaaaaaaagaggaaaattagagaatataaaacttatagttgtgtatttaaattatttttccttcaataaaaacacccgatgaaaaaaaaaaacttttccacttctctcattatattaggatgagtaccatttaggtaaaataccctttcccaactttattatttataatcaaggaggaatagcaaagtgagacagattcattcatttcatcctttatttgagctgttttaaaacttcttcctcttccttacaaaggaaaaaaaaatgggatttcttccatgttctttgctttgtcaagcaaagaaaaaaccattagattcttgtgatcaaactgagtctagacatctttcctcaaattcttcatcatcattaatatcattatcctcgagatcattatcattatcatctaggtcattttcttcacagccaagtttaccatcaattccttctctttctatatcatcctctcaagttgaacatctctcaaacaccttccaccactgcttagccacactaacaggccattcttcctacatattttgcctat

SEQ ID NO: 498 - DNA, 14370 bp, Solanum lycopersicum; identical to SEQ ID NO: 497

SEQ ID NO: 499 - DNA, 12504 bp, Solanum lycopersicum
catttaattaagacatgcaatttaaatttctcaagttatattttttcacaaaataaaacctacaaattgtgatatttataagaaaaaaatcattcttatttaatcttaccaaataagtaaatcataaatcataaatcataaacaagatatcagaatatcttacgacaccagattaaagaatcaatactctatattcttttgataaataaatagttatagttacaaactttaaaatacacataacattataaaaaattactactcaatataataacaattagctattatttaatataattttttcacatgatacatataattcgttcactccaaaaacatcatctctttctttgttaaaattaaaaataataaataataaaatatatatttataaatcaattctttaaaaaaaaaatgataactttaaataacatactcaagcaactacttaacataaatgatatatatatataatatatataacaacctgtgactagacctgtgtgactatatgacaaaagtttattaaaataatattaaaaattttataagttttaaattctgaattcgcctccgaaagttagttataactactacttccctaacggctaactttaacaatataagtagcatgaaaacatgcgaagcaggaccactctccttacacggcacgtggtcaagacccaaattaaacgaattcacagagatttaacactttaactgtagttaatcttttttaactttaaagcctttttttttcacaacttttttttcagattataattagattaaatttaaatttatatcgataaattttgaatttacgtcagtaaatctggagtaaaatgaatttgcataaacttaaactcgagaatttttaaataaatataaaaaaaatatttatcattttactaaattaattttaaaaataaataagtataattaaaatatcactaacagcttaccgagaaaaacatacatatttatcggtaaaatgaggtttattccagtctatgaataatcccttgtgtatttctgttttcagcttctttcctattttctctcacccacccacaggaatatctcttctaccattctgtgagatctccttcaaagatccattttcaggtgagtaaaattcagctgagatttctacaattaagttacacttcttttaccagttatatatacaaaaacaaaattctaaattttttacattatgaaattgaagaacaaaatgggatttttgaggtgaggtttgatgtagaatttaatgttctgtcggtttgctgaaattttcactgatcaagtcctaatttttgttactcatttcttgaatttgacaaaaaattgggatttattgttttgatgtagaatctacattctgattttggtctttggggatctgtgataaaatgaatcagttgatgtaaattcacaaatttgaatgggactgttgataaattctgattttggtagagtttctgaaattctgtttatgtttttctgtaatttctgggattttttttttaatttgggtcatttcatctttaatttttttttgcaggatgatttcataaaacagatttggtacttcagaattaataaaaccttatctaagccctgtatctttggttgagtttttctcataagaaattcattatgtcaaattgaagaaaattaaaaggggaaaaaagattgggtctttaccagtttgcagaactgcagaatggaaacaggccaaggcagttcatggatcccagcaactccagggaagccaagttttgccgaatcgccaccaatttgcagtacaggacaggaaaaccagcaagctcaagttgatttgtcagatttgcaaagaaaacaagcagtagagcatgctaatggaagcacagctgaagctcaaaatgctgtagagcatgctaatggaagcacagctgaagctcaaaatgctgctgcaaatcgcggttcaacaagttcagtagaagatcagtgcttcacgacctcggaagcagtagtgggaacaaagtctgaaatgtgtggaggtggtataaatatgtacaataacttccctagtgataatgtagaattgtggagtagtatgtctttcggggatctgttggcgatggcacatgctggtggcagtggcaccacgccagctgatgaaacagcttatagtgtgaagagttctttccaaccgctcatcaatactcagaatgcaggtagaaaattgaagtagtcattgattcattcatttctgttaattgtaatgactctactgcttggaggattttcagattacaataattgcattccatgtatatgtcaagagcttctttttacctgcctcattaacacaactttgtctttgtgcattgtaagacctgcaaaatgtttgacaatgaaatataacaagttcagtatcattctttggtaatttgaaacttacatctactaacaatttgaatgcacagcatgcacgaatcagctcatgttgaattgaacaaccctgtgaatacttactgaagttccatttcaactaaaataatgtatcctagaacataatcaaaatggaaacaaaaggtcacatatatgatccatgatactgtgcttctctgattgagtgttcaactgttagagtgtcattccgagtcaaattatcctattgttatctctgattgctccaacatgttttgttttggtttcatttccatgaaaacaggtcggctaagcatcacaatatcatgatctaggtgacatgtcaaaatcttaagaaatttgttgcttcaagtctgagattatttccttgataaattaatatgacataagagaactcattgtgcagatgaaagctctattttatccagcttccctttcaacttgaattcaccaccaaaaatgacgggtgcaaccttgagcagcaacatccaattccagtttgaaccagtaacaccagatatgatgaagattaaagggcaagcatctaatgcatcaaacctagatattaatgtgacaaccgcagcaagagttatacagtcaaatgaggatataataaagggagctgaagcaaatgaactccaacagaataaagagcagtcagtgctgatcttggaaggcaaactggatactgaactgaataatacaccagagcaaaaaacaagacgaagaaagcacaggcccaaagtggttgtagaagacaagcctaaaaggactcctaaaccaaaaatccaaaagcagcctggtgcagaggagacaaagacagaaaagaggaaatatgtccgaagaaacaaggttggcgaacctacagccacttttgcagatgaggtaagcaatacaatctgtcacgagggaaagcctcctagttccgagaaaaccccaacagcaaaaaggaagtatgtcagaagaaatcaagtgaacaagagcacggaaaaaccttctgaagaaggaagcagtgtaacaattggcacacctgcagccacctccacagaagaggtaaagaacacaacttttcatgtgggaaaggctcccagttctgaagaaactccaacagcaaaaaggaatgtcagaacaaatcaagttaacatgagcatggaaaaactctctgaagaaggaagcagtggaacaaatgacccgtcagaagttcctcattctagaaaatcctgcaggaaatcattgagttttgaattggaaagccaagcaagtgatgagtattcatcatacaggccgtcaactttggatttgcatgcaaataactctgggtcaacagcacagtctgttcagcttggacaaggtaaagaaaccacaagtgaagaaacagaaatgggcataactcataacatcacccgctccctgaatcaagaggtgagaaattacttatcacagcctagaatgcagtaccctagtcctccaactccggacaaggttggctggaatcatgacaaaaccatggttgggaatcacaatgaaagcacaagaggaaatagcagaatcattttttcagatgtaactcatgataaacaggcaagcatattacaaatgacaccacagagcctgaattccaactgcggcagcagttcatgcttaccacatgggaaaggcttgaaaagacagcattcatgtagaactgatgaagcacaattctacagcataaatgccaaagggacgtatttcaattctatgcaggcttatcaagcaattcttccagcaaataaacctgatgtttatagtaatgtagggatgcattttcctgctatttacaagaaaatgagagcagaaaagggccacatctcaacatcatcttacatcaaactttttactggtgaaactaactacgtttcttcatctcagtgctatatcagtggttcccctagtaacaattctgcaaccaatataggcaattatggaatgtggaattccaatgttatgccagcatttgtggaagcagagaggttgaggaacaagatatcaaacggcccaactcaagtacatgacattgcatctctgcatgaaatttacaaacaatttccaacttccacatctaaagaattaacaaaatatggatttggagaaagatataaaacttcacatctatccagtgcatgcatgggaactccaattgcagacacccaagcagcaacgaagaaaaaaaggcagtcaaagaagagcatccttgtcagctcggcagcttccaacttatatacccatcaacatgttgcaaaaaatgcaaggggtacataaaggcatatactttaactatcaattatatcataactcttttcttgctaacaacattgaatgcaggttctctgccagctttaacatggagaggcatgtctccaatcgatgaaattgcagaacgcttgcggcttcttgatttaaatagagaaagcagccaaaatcaaggtccacatggaatcacctaccacaccaagtttcaaagggagagtgctcttgttctttatcaaagagatggaagtattgtcccttttggaagttcgttagttagaaaacgaaaaccacggccaaaagttgatgttgatgatgagactgatagggtatggaagcttttgctgcaagatataaacagtgaaggcattgatggaacagatgaagacaaggctaaatggtgggaggaagaacgtcgagtgtttaatagtagagcagactcatttattgcacgcatgcgtcttgtccaaggtaattgtgcaaagtcttcaacctttcctagtggctaggtcaaattgccagctagattccttcagtagaaacataggtagaagaagatattgctagtttaaataagataagaatgggtatgtttatatcattaatctgtgactcaccatgtggtaatataaaagaattgaaaagtgagacatcaactagatgttgatcttgcacaccaagattcacatacccttactatatttccctaggaacactttaggagtttaaacatgccatatcaaaagaaaaaaaatgtcagtgacctgttttttctgttgtaataaccataaactttattctcttcttttttgggtgagtcaggagacaggcgcttctcaccttggaagggatctgttgtggactctgtggttggggtatatcttacacagaatgtttcagatcacctttctaggtaagctgctataaacttctacagttttggaatttttttcctgtcttccagcaaattcctaaacattcaaagatggaatgccaacatattgcttagcccacttttgtccctaaaactatttactttatcctatttccagttctgcattcatgtcactcgctgcccactttcctctgaaaacagacagtactcagaagcatgaaggaaatacaggtattataattgaagaacctgaagagtgtgcaacagaccccaatgtttccatcagatggtatgaagatcaaccaaatcagtcaacccattgtcaggattcttcaggagtctataatacagattcaaatgaagaaaaaccagctgtcaatgactctgaatcaagtgaaaatagcacagaatgcataaaatcagcagaatgttctgtaattctgcaatcagattcttctagagaaggctcagatctgtatcatggatcaacagttacaagttcccaagatcgaaaagagttgaatgatttgccttcttctccgagttctgttgtttcttctgagatctctgctgttattcaagcttcagaaggaactgactcaagcaacttttgcagctccacttcttttttgaagctattacagatggcaggaacttcaggagcacaaggaaccaggtgcactgaacatctacaagaaggtgaaaacgttccattccttgaaaaggaacttatttcccccaaaaaaagtgtattgtcagcagaatctgcacattcagcactgtacacaacccctcaaaataagttggacatagagacaatgactgatgcagaagacaatgttgaactacaatttccaactgaagatagcaatagcaatgtccagcaagttcctgaagccccagcctgttcagagaccattgtaaatgtcacagaaagggccagcatagtttttgattcatgcaagcctgagcaaagaggtttggagtccagcttgaaaaatgacagtaatcatgttcgtagcaaagtagacaaagtaaatgacaatccttctaaagcaaaaaatggacagcttgggaaggagaaagagaacattgattgggacagcttacggttacaggcccaggcaaacggcaagaaaagagaaaggacagcaaacacaatggattcactggactatgaagcagtgaggtgtgcaaatgttaatgagatagcccatacaattagagaacgaggaatgaacaacaagctagcagagagaatccaggtacacacatgagtattgcattgcataaccttctttgcaatctctgatgacaagagaatatatgcatgtcagcccatagtactaagatcctgctatgtgtgggttccgcagaagggccaaaccaaattgggtctattgtacacgatcttcccttgcgtactatagaaaatatacatctacagtatttattttgcctgaaatccccatgattgctctattttaaaaaataaacttgctattgcaggcttttcttaaccggattgttagtgatcatggaagcattgatcttgaatggctgagagatgttccaccagacaaagcaaagtaagccagcaattattccaaataatctcccttgtgtaagattctagtcatgtacaaactataacaaagttcaaatgtatggtttcagagagtatctactgagcataaggggcttgggtctaaagagcgtggagtgtgtgagacttttaacacttcatcaccttgctttccctgtaagacctaaaaccaattccggatgagttaaatatacgagaaacagtcatttcattacactaatttctgtgtttctatgataaggttgacgtaaatgtagggcgtatagctgttagactaggatgggtgcccctgcagccattgcctgagtcactacagttgcatcttctggaactgtgagtattcctgaatctaaatctttaagcatacatagtgcaaggctaactctgtggtattcctacaggtacccaatactggagtcaattcaacagtacctatggccacgactctgcaagcttgatcaaagaacattgtaagtagcatctattaaacatatatatatagacagatgtcgagctctgattgtaactagaagtaagtaatccaatgacaatcttttggtaataatcaaatgatgtaaagtattgtttactcgtactaagattgtttagaaatgattttatttttcttccgatctaatcgtccattaatataagatcttacttacagatatgagctacattatcatatgatcacctttgggaaggtatgtcaatatattagatgatatctcctaaaagttatagatatctagaatcaaaggctaaaggcactcttacatttcatgtaggtcttctgtacaaaaagcaaacccaattgcaatgcatgtccattgagaggagaatgcagacactttgcaagtgcatttgcaaggttagcatactactatttatactttctgcagctaaaatacttctgtcctgtttgtccaactatcttgcttcttatacataaactatttactcaaacccaaaggatcataggtctacaatgtttttggtataaaaaatctactatgtggcagtgaattgtccattgcaagctaaccctccaatatataaaatataaccatgatgcattctagtatataaaatttcattcactgataaagcaatttcatgctaaaaattttagatgcatccattttttagatggcttcttaaattaactagcttattaatgatatccatactgcaagcacattgactgagagtctgagactataagacttgaatgactattttatctgtataaactttaaacagtcagatacattgtatttcataaacttgacctaataaaaatgcctcattcagtgcaaggcttgcccttcccgcgccggaagaaaaaagcattgtcagtgcaacagaacagaaagccactaacaacaatccaagggaaaatttcactcacctgcctctgccattacctccgggtaatcaacaaccagtggagaatcagaaattgatcaattcagctcctattattgaagtgccagcaacaccagagcccattgttgaagttccatccacacctgagcaagagcaaataaaagcaccagaaatcgacatagaggacgcttactttgaagatactaatgaaattcctatgattgaattgaatatggcagagttcactcaaaatgtaaagaagtacgtggaaaacaatatggagcttcatcaggtagaaatgtcaaatgccttagtagctttgacttcagaagctgcatcaattcccacgcctaaacttaagaatgttagccggctcagaactgaacatcaagtgtaagtaaaccatcctgattttacatcataaaaatagaattatgctgccaaagaagcactaacaagagtcaaggatagactgtacttttcaaggtaatacaatgtttaaagaactttttggactaactatcaattgtttttcctcctacagctatgaacttccagattctcatcctcttttggaaggggttagtattagttttatgtccaacatataaccagcagccaagcagatataaaactaatcctccagagaattacatttttcattttgcagttggacaaaagagaaccagatgatccttcttcctatcttcttgctatttggacaccgggtatgatcacaagaactgtaatgcactaatgctatatattgaagaattttgttttggaaggcttccttccactatttcttgtaatgtggaaaataaatgaattagctaggtcatgcttaagaaactattgatgtagctatcacgttggtaaatatagagtacaaatttcatggctttgtttaagttgtaggtaatatcagttaactttcatatccccatttcagcacttgactgatttcatcgcttgtatcaaattcatatcaggtgaaacagcaaattcaatgcaacctccagaaactcagtgcaactctcaagaatctggcgaactatgtgaagatgagacttgttcctcatgcaacagcatacgtgaagcacaatctcaaacagtaagagggactcttctggtaagaaaatccatagactctaatagtggtcatttcatatgagtaaacggccaaaatgatacatacagtatgattaatcattgttcttgtcaatagataccatgccgaacagctacaagaggaagctttccgctcaatggtacatactttcaggtcaatgaggtaatataaccaacttttagctcatttacagctccacacgtcaaagactagatttcgcatcaagtattgtaattttcattgatagaagttacttttcaggtgttcgcagaccatgactccagccttaacccaatcaatgttccaagggattggctgtggaatctcccacggcggactgtctactttggaacctcaataccaacgatattcaaaggtgaaagaaccactaaactgatggaactcattagaaaattttgggagtaaaataacattgaaatttgttgtgttcatcaggcttaaacacagaaagtatccaacactgcttttggagaggtatgtaaatggaaaatccttaagatttttgcagcgaaaagctagcttcttatccatttcaacaatgttaatccctgaaaaatacatgttaaactagcttaatgttgagatgccatcctgttaaatacacagataaaacggatcacagtctagtctgtttatatttaaacatgccattgtcaaaatttataatgaaagaagcatcagaagaccttggaaacaaggattatataaccactcattgtcaggagcaaacctaaaacataggaaacaaggatcaacaatgctcacctttgttgggaatcctatttattttctgtttgccttctacctcttgagtcctccggccctcgccttcaccaatctgagtcccaaaaaaaggtcctctaagctagggtctagaatatacaatagatgtacttttagcttaggactatggtagtatacaatgacaatttatgttgttctattctgtctaattcatgtgatgattgatttcaatgcaaaaatgacttctgtacagtttacactctatgaacaagaatcttgttttcaacattatctattcaatttaaagagtgagaccctttggacaataagcgttactaggactctttttttggtacatatgaagcaggaatgaggtacacacacatagctgtaagattcatttgaaaaaggacactggttttgaacatatgttacaaaaggtctgacataagtactaaaagtatacaataacagtaaaaaatgcaccatttttgacaattaatattttgttccacaagcatttggacaaatgggaaactttggctatgacaatagaatattagctaacaagaagagtttgacgtcccctgctgcaaaacctttttgcttttctgatgaatagatattgtatttttctcagggtttgtttgtgtgcgaggatttgatcataagacacgagcacctcgaccgctattggcaaggttccattttccagccagcaagttaaataggactaatgggaaaacaaatgaagacaaaggagtagcctcctgaacatagctacccaagtactcatgccaaagccaaaacaatctaacaacattcaatatcatgtagttctattccagtcggtaaaaagaagataggtgtatctggttaacttgtaaatgagataataagttttttttaggttatggagtttctttagttagcaacaatttattgaattattcaatcagtttattctcaattagttcgcttgaagtccgcaatttacatctcctttctctttcaagtcgagggaaagaaaactacattgacaccagtaggaaaatcagatctatatatgggcatgtataacagacttacagagccccattatctttcttcaggtagcaacaacaccgcattgtgttacgtaacagccctaaactggacagcattgtagtattataagttctttgctacacatagtttgaactttgaagtaatagtactactcaaaactaaacatgttaatgcacctgctactgctaatggtatcttaacgtactgaaatctcactaaaactacgtgcgttaactggaaaaagaggattgttttagcttgcaacttcgtgaagctgagaaaaaaactacattcaatttcagcaattttgatgacaagttcttaacctgaacaagcacagaggtagattcaacatttacatcgatcgagttggttcaaaagtggttactgcacacagatactattcacaacttttttcgcatatttacatatacatgattctgaactcaaccatttatacaacaacaatttatcgagtgtatgcacattttcaaacagttagagaaggggaacacaataagaacagaattatcaacaattcacccagatgaagcttcacatttgatcataaccacataaataggcgatactaacgcttttttcaggactaacaattacaaaaggaactacacagaatcacgaatcatcacatattgataataaattgcacattaatcatcacgcataatcgataaaccttactcaaatatcaaaatagtaaacacagcataaaaatgttaaccaatgtaccttcgtattcagatatctgcatcctctcgcctcaaatgtaactcgatccattgaactcataacattcgactacaataaataatagatatgagagacgtaccagttcgaatcctgaatctaactcggctcaactacaaggtaactcgattcattaaggatacagaattcgaactt

SEQ ID NO: 500 - DNA, 5707 bp, Solanum lycopersicum
gttaaattttttgttttgaatgtagaacttatgttatatttttaatttcatttgttgaggagtattgacttgatattttacattacaagctattcttttaacttagacttgatagataattctattgtcaaatgtgaatctttttgtcaaacatgcatttcatgaattcatagaaattttgtatttttaatttttatgattaagttagttaaaaacatactgaattgagaatcataaattaatttttttataataataattaaaaacatatgtttattaattaatatattttcaaaagacaatatgtatcttaaatattcaatttatattatttatacaggcccttgtttgtcttatataaatttttaattttaaataattgatttttatttttaaaattcaatataaccttatgactacacttgtgcaaccaaacagtatacttgcaatacactgcaattacatcgtggcatacaggtcaactcaattactaggttgtgtaattattgggttgatattactaccctagtaattacacttaatccaattatctggtggctatccaaactaaagtaagttatgcgatcaagtttagagattttttttttttgtattttctctaattttaatgtaaaagagttttaaattgaattgaacactatggaaagtagcatttcattatcaaataaatagttgacacgtacctttaatttcattttattccaagagttccttaatgaagttgaaaatttataaatttggttaaaatttcaagtgctaaacttccatatttttggatgctttgggttctttttgtgtgttttatttgacatcaccatcattatattaactaatcagacaaatttatacactatgcataccaaacttagtgaaagcttaaaaattataaatttgtcagaataattcttttaactaataatttttggtataaatatgagatgtttaaactcgaaacctcacgactaaaatctatcttttcttttcttaattaaaaaaaaaatatttctgtttaaatagttaatcatgtctttgggtggaattgtggatgccatccttggaaaagatgataggccaaaagtgaaaggaagagtgattttgatgaaaaaaaatgttctagacttcattaatataggtgcttcagttgttgatggcatttctgatttacttggccaaaaagtttctatccaattgataagtggttctgttaattatggtgggtaaaattgttcttttaacaaagataattaagtttgccttttgtacttattgaaatcggaaaaatggtcaaaattatccttaactttgttttgttgcggttaaaaaaagcaagttatttttacccttgcttagatggaaatcaaattaagatgatgagatattattggttactttgtttcatttgcagcagatggtttggaagggaaactgagcaatccagcatacttagagagttggcttacagacatcaccccaataacagcaggggaatcaacttttagtgttacatttgactgggatgacgagtttggagttccaggagcattcatcatcaagaattttcatcttaacgaattctttctcaagtcactcacactcgaagatgttcctaattatggaaaaatccattttgtatgcaattcttgggtttatcctgcttttagatacaagtctgaccgcattttctttgccaatcaggtacattataattcaatgtatatgtgtctaaacatgtatttgcattgtcgtaattatggtatgttcttcaggcttatctcccaagtgaaacaccacaaccattgcgaaaatacagagaaaatgaactggtagctttgcgaggagatggaactggaaagcttgaagaatgggacagggtttatgattatgcttgctacaatgacttgggtgatccagataagggggaagagtatgctaggcctatccttggagggtcctctgagtacccgtatcctcgtagaggcaggacaggccgcgaaccaaccaaagcaggttacgacaatgcagaaaactttttagttttgtaactcaacaagtataataatactatcagcattttcatgtttgattttttggaactctttttgttctctgcagatcctaattgcgagagcaggaacccattgcctatgagcttagacatatatgtcccaagggacgagcgatttggtcatgtgaagaagtcagactttttgacgtcgtccttaaaatcctctttgcaaacgcttctccctgcgtttaaggctttgtgcgataacacgcctaatgagttcaatagctttgcggatgtacttaatctctatgaaggaggaatcaagttgcctgaaggcccttggttgaaagccattactgataacatttcctcagagatactaaaagacatccttcaaacggatggtcaaggcctacttaagtacccaactcctcaggttattcaaggtatttatttatatttctacatgatcaaaaacaatttctttaagtattatttctcacgccttcaccttttgtaatataaatttgttggtgtttaggcgataaaactgcatggaggacggatgaagaatttgggagagaaatgttggcaggatccaatcctgtcttaatcagtagactccaagtaagctttaattcatcttttctttgaagatatcaagatcacttctattttcatgatatttccatgcacattttgaagatattggtctatctgatgtctgcaggaatttcctccgaagagcaagttggatccaaccatatatggaaaccaaaacagtacaattaccacagaacatgtacaggataagttgaatggattaacagtgaatgaggtatattacttctgtttcgatactagttagattctttgatcaggttttgtgacaaaaacagatactctttaacaggcaatcaagagtaacaggttattcatattgaaccaccatgacatcgtgatgccactattgaggaaaattaacatgtcagcaaacacaaaagcctatgcctcaagaactctgctcttcctacaagatgatagaactttgaagccactagcaattgaactaagcttgccacatccagacggagatcaatttggtactgttagtaaagtatatacaccagctgaccaaggtgttgaaggttctatctggcagtttgccaaagcctatgtagcagtgaatgacatgggcattcatcagctcattagccactggtaaaaattgtcagaaagctttatatgaaacacaacttacccataaccaaattcaatgtattatttagtaattcgagacgtttgttgttacctttccaggttgaatacacacgcggtgatcgaaccatttgtgattgcaacaaataggcatctaagtgtgcttcatcccattcataaacttcttcatcctcatttccgtaacacgatgaacataaatgctttagcaagagagaccttgacctatgatggtggttttgagacgtctctttttcctaccaaatattccatggaaatgtcagcagcagcttacaaagattgggttttccctgaacaagcacttcctgctgatctcctcaaaaggtaaatgaagagccacaaatatctcatactctgtactaaatattaaataatatatcagaacataaatatatgttttttcgtcttgctaacctgaccataatgtcgttcaattacagaggagtggctgttgaggacttgagctccccacatggcattcgtttactgattctggactatccatatgctgttgatggcttggaaatttgggcagcaatcaaaagttgggtaacagaatattgcaagttctattacaaatctgacgagacagtagagaaagacactgaactccaagcttggtggaaggagctccgcgaagaaggacatggcgacaagaaagatgaggcttggtggcctaaactgcaaactcgacaagagctcagagattgttgcaccatcattatatggatagcttcagcacttcatgcagcactccattttggcttatactcttacgctggttatctccctaatcgccctactttaagctgtaatttgatgccagagccaggaagtgttgagtatgaagagctcaagacaaatccagacaaggtattcctaaaaacatttgttcctcagttgcaatcactgcttgaaatttccatctttgaggtctcgtcaaggcatgcttcagatgaggtttacttgggacaaagggactcaattgaatggacaaaggataaagaaccacttgtagcttttgagaggtttggaaagatgctaagtgatatcgagaatcgaattatgataatgaatagtcataagagttggaagaacaggtcagggcctgttaacgttccatatacgttgctctttcccacaagtgaagagggactcacaggcaaaggaattcccaacagtgtgtctatatagaacttattattcaatcagtttgttgtgcttgtgttacttgttattcccaaccaaataaactctttgttccaaataaagagtattgtattgtattgtcttgtgtgttgtgttgtattgtattatattgtatagtattattgatttaaatacaatgtttgttgcacttgtttcttgttattcccaaccaaataaactctttgttccaaataaagctgtagttggttttatttttcatcttctctttgcttatttaacaaggaaatttatatactcactagactaggaggttgcaaaagttgcaatctgttgaacctgaacttaccaatctattggatatatatgattacattgaaggaggtatatacaaatatacaggtaggagatacacattttatcctctacttgaaaactagactcaaatttaaatccaaaggaccaaaccattccaaaactgagattcgaactccttaagatatacccaatctattgtaacaacactcgcttgaaacaaattaccaatttcaaaaaatcaatacaaaaaaaatgataataaccatccaaacaagctgttacagaagagaaagaacttaattacaacattattacaccctttattgtaattggaactttctttgatagagattttatttggtgttaataacagaatactaagaaacaacatgaacaaacaataataataagttctatatagacacactgttaggaattcctttgccagtgagaccctctccacttgtggggaagagcgaaatatatggaactttaacaggccctaacctgttcttccatttctcatgatcaccattcatctgtaaaatctgattcccaatatcactcagcttctttccaaacctctcaaaagctaaaagtggttcttgatcctttgtccattctggtgagtccctctgtccgaggtaaagtgtatctgaaccatgtcttgacaagatctttaagacggaaatttcaagcagtgtctgcagtggaggaacggttgttttgaggaataccttatctggatttgtcttcagttcttcatattcaggacttcctggttctggcatcaacattcggcttaaactaggccgattaacgaggtaaccagcataagggtattgcccaaaatttactgctgcatgaagtgctgaagctatccatattgtgatggtgcaagattctatgagctcttgtcgagtttgcattttaggc

SEQ ID NO: 501 - DNA, 11889 bp, Solanum lycopersicum
ggagaaaaaatctaggtgaattggtaaaggtgaaatgaagatgaagagttaatatttagtgaaaattgtgggccagcttgaatgaaaactttgatatttgtttgataaaaaaacacgtattaatgctgatttatttttaaaatatttgataactgagtaattttttttatatataatatttattaatataacaaaataaatataacgttgggtaaaattatcaaatctaaattaatttatatttattttaaatagatttaaagaatgactataagaaagtagaaataacgaagatagacataatatcataaaccaaggaaaatgagtattatagagcgaaatcgaatgaaagtctctaaaattatcccttttattttatacattaaaaaaaatctgaaaatagttaaagagatctcaatttagctttaacacattaagaaaattatttattatccaccaagtgaaaaatatttctaggacgcaatttattgtctccttaaggcaaaattattttattaaaaaagctattaattaataggtataaatagtaatttagattacaacaactcttaagataaagaattctgaaatcataagctgtttttttcctgtcaatttatgattgctatatattgtatttattcaattttaagtgtcacaacttttgacaacatttttatttttcaacatatatacctcaataatataagttttctgcgaattttcagactaatcccaaagaaaaaattctcatgtaattcacacttatttttataaaaatccattataaatatgcatacatatttataaattgtgaaactcagtaattaaaacgagcgattaatttgatataagttcagaactcataaactttaaattccgattcagcgttcgataatatcttgaaaaaaattctacatgcccaaaacaattcacacacataggtacctaagcaaaacttcatcatctatataaagagaactccttaagagaccaaaatgcaaaccaaaccatatatcaattaaagtttgaaataataaaaatgttgaagcctcaatttcaacaatctacaaaaaccctaattccatcttggaatactaatacattattcttagcctcttttcccataaatattttaaataaaaactttatacttaaaaaaaagaataattttagggttcatcataattataatggtgcaaataccattaaggctgtgcttaattctactcaaaaatccataggtgttaaagctgtggtgactgtccaaaaacaagttaatttaaatttattaagaggacttgatggtattggtgatttacttggtaaatcactaattttatggattgttgctgctgagcttgatcatagtaagtatattttattcactcatatattaattttcgttcgtaaataaaagtccgttctctctctttttacgtgcattggtcagggtcaaagcagtgacgaatcgaggaattttgttaatagtaatgtttaatgtctaatcatatatatggtaatatattcatgggaaaaggatctgatatatgagctacttttataacgaggggtatatcagctccaaatgacaaagttgaggggtatatcagacccttttccctatattcattataattttttaataatgaagattgttaaactggttattcttcgcataaatcatgtcaaaccaagatcaatcaatatccgaacggaattgattcaaatggtgcgaaatgaaattataggatagatatgagtatttcaaagtagaaatagtatttgataggattcgatagcaataaacaaaattaatagaattatatactagaactgaatcactatgcgaatcggaactaatgattgatttattcaaacattcaagattctattaataaatttattgtacatttgtaaaatgtgcatttatgaaatttatttagttagtaggagtagtattatatgttgtttgagttcttcaaaatgctagtgtggattctttaaatttgaagtttttataacataactaaactcgtatatgtgtaattaaataacaatatgcttttaattagtttttcgatattgaaaaatcaatatatatatatatatatatatatactgtcatctatgtaagttgaatgtttaaatagaatttatcgataaattaggaaaaaattattaaatatattattaaacccagtagaatgagtcacatcacatggaaaaaaagtgatgaaaaaggtatttggtttaaacatttataatttttaaattattatgagatttgttattttatgcaaatgagttaaagatagtttttttttgtcaaggtagaaaattgtaggcaatattaaatttttgtgactttttaactagctagagaagaataattttattgtcatatatgctaaattttcacttgaattatttgagcgataaactctataaaagtttttttttcagctatatttttgaacttttataggattttcgatttcatttaaaaaatcaagttaaatattaaaaaaatttgaaaagtaaattgttgttaattttgaggtgtgatttttcactgcggagatctttgatcgcacaatgtattttttgttaattattttgaataaactttaaacttaacatacatttaatgtatttaaattgttcaaatatctgaagcttattacaaaaaaaatttagttcaaatgataaatcgacgaattatcttatttttttttaaaaaaagaattaaaataaaccaacatagcaaaccaaacatggagaaaaaaatattactttgtgaaatcatcaagtttcactaaaatgaaatttggaaaattaaaaagaacatttataaccacttcattatataattaaaaagggcatcaaattacaaatagaaaattaggaaaagagataagttatcctttcattttctatggataaaataaaatctcacaagtaatatatgtggtggtttaatttatcattgatatggtataaaatttctctgttttaatttaagattttgaatttgcgtgcgtgcaaataaaaaaattctcttaaaagggatatttacatacacaaatgagacttataatatataaatttatatttaatcgaatttaagaatatgtactgagtacactaaatataaaatccaaaaaaaaaaatataacttatcaaaggaagcaaatttaactttgacaagttttttcttttaaaaattgaaaacaatataaagtttaaagtcaatatttcagctcccccccccccccttttttttttttcgcaactttcatatatcgcaatcattatattttttttctactaattagtttcttccttcatatttcatttaatttaaaatttttaaaatattattaatatttttttttgtaaattcaatttttttgaaagagactggacttgaaaagccaagtattaggtcatatgcacatcgtggactagatgtggatggtgacacatattatgaggctgtttttgaaattcctgaagactttggggaggttggtgcaattttagtagaaaatgagcaccacaaggaaatgtatgtgaaaaatattgtaattgacggttttgtccatggcaaagttgaaattacatgcaactcttgggttcattccaaatttgctaatcctgataaaaggattttcttcacaaataaggtttgatataatttcttctttttccctatttctttttattatttacgataatcagagatattagataggatttcttcgttcagaataaaacatgtgtagttgattgattagaatagatgaataatgtactcgcctttatgtgattccaaacatttatcgtatgccgttcagatagtcaaattgtggaacaatcgaaataacactgaatagatttttaaaaaatggaaatagtcgaatttttgttagggacatattgtggtccattttccaaaaaaaaaggaagaaaaatactctcctctcatttattaagaaaagaaaaacataatagtacaacaattttggggcttgtggtcctttatatttgcttaacttgttatatatataatgttagatttttcgaaaattattgtctagtgatatataaattttgaaaaagaaaagaataaaaatgatattgaattgtgaaaaaactttttgataaatagtggtagtaagaattatgaaattagctcatgaaaacatgacctgcttaggtcatagtaaagaaaagaagttatattttgttattaaacaaattacacgaaagatactaggaaatatacaaggtaagagttgaatgagttggattattacctatgaatttagtaattcgattcgattcgattcattccatcttaattcaaataacccttgtataggtcaactaatccccccacctcgacccccaccccaacccccaactcgttcaaatttagtataactcgcttctttgacactcttagatgtacaatagtgagatttgaactgataactctggctattataatactatgttgaagtatgctacgactattcttcaaaatgttaacgttattttattcatttacttaattatatcgtcaaattttgcagtcatatttaccatctcaaaccccaagtggagtaattaggttaagagaggaagaactcgtgacattaagaggtgatggagttggagaaagaaaagtatttgagaggatttatgattatgatgtttataatgatctcggagaagtcgatagtaataatgatgatgctaaaagaccaatacttggtggaaaaaaattaccatatcctagaaggtgtagaaccggtcgacaaagaagtaaaaaaggtatattatttatgtctcgtgtttaaacttttgaaaatatataataatgtgagttaatcaattttagatattaaataattatatatgaaaagtaaatttataatttatctacacagttttgagaaaatataccacaagtacttctctataataaatcaataaaaagtcgtaaattggtcaatcataatttataatatttcagtttataagcattttaagtttgaccaaggcttttattattttgacctaaagaaaactatttagcctagagtttttggaatgagaaattgaaataaataattatccaccaaataattcattttagatatgtaatagtgtaagtatttttaatatatttaactatgtgaattatatttatttttgaacgatcgaccagatatgtgtaacttctacaaaaaatttcaaaaatgaaattactaactccctctatattttattttttccattcatcaccctttaccaattttataatatatctttttgttaagtcattttaccaaatataccaattgcttaatgcatgtcaattaattcattaaaaataatttctttcatttctatccaaacacataagtcaataaaaaataaatttctatagtttatattattttttaacatctgacaattatcaacaacttttaatcagctaatcaaaatttaacatgtcatagaaacttatgttaaacttattcttttatactgttaatatatagaagttaaactcgtattaaattgtaattattattttttgcatgcatgtagatccattatatgaaacaaggagtacctttgtgtatgtaccaagagatgaagcattttcagcagtgaagagtttaacattctccggcaacaccgtttactccgccctacacgcggtggtgccggcattggaatcagtcgtatccgatcccgacctagggtttccacattttccggccattgactcgcttttcaatgtgggtgtcgatctttcaggacttagtgataaaaaaagtagcctttttaacatcgtaccaaggcttattaagtctatttctgaaaccggaaaagatgtcttgctctttgaatcccctcaattggtccaaagtaagtatcgaaaaacctcttgtataaattaactatgttgcttagaatattcaaaaatgttaacaggtgcgtttttcttttatattgttggatcaacatttattttcatttgatgatatcatgcagagttcgagcttaaagagtgaaaaatgttaaccaaaatttcaaaacggtatatgaatttatagtaacaaaaataaaaattatataccgttttgaaatttttgttaacattttttcaccctttaggctccggactcatatcatgcatctagcactttaaagaatttttttaccaaaacaagccatcatataaagcaatttacaaaataatacattttttcaaaattttacaaaattaataaacgtatttcacagtaaccttttaggagcaaaatgttattgtgaatagtgtatatgtcaactttttaaaaataaaatataccctaaaaagttactgtgaaatacgtttatactagttttgtaaaatttttaaaaaatgtattattttgataaattgctttatataatgacttagtttggtcaaaaccttcacttttaaagattaaaaaaaaatacaaaatattttactagaaacctatactttgtccatatctttcaaaaaaaaaaataccattaaaaaataattttactagaaactccaaaaatgttattattcatgtatttaaaaaacacaccacgtatttcaataataagacataagtgtgacaatatttttgaaaattactcgtacgatttaatattttgtgttttttttttctcttttaatattcatggcaggggacaaattttcttggtttagagatgtggaatttgctagacaaaccttagctggtttgaatccatatagtatccgattggttacggtatgttattccgataaaaaaattattcgtatcagatatttatgttattccgataaaaaaattattcgtatcagatatttatatcgactcatatagtgtataggtcactataacttaatagatatctattttgagttcacttatgttaataaaaggaatattagtattgggaacataatatgatttcaaatatcatatgcttaattattattaatagactttatcataaatatcataaaaataaaatagaattagctataaactttattactaattataaaattttatctgtcgctaactcgttacgaaatacaggaatggccattgaggagcaatctagaccctaaggtgtatggacctccagaatcagaaatcacaaaagagcttattgagaatgaaattggaaacaatatgactgttgaacaggtatatatatatatataaattgtttatttatttattttcaattatgagaaaaaaaatatttttttgatttgtttgtggacaaacgatatctagtgtggccaattgtttgatcttttttatttgggcaatatgcacaagtacccctaaactatgactgaaatcccagagacacaccttaactaaacaaaagttctatttccctcctgaacttattttttttgttattttatacggcttttgtcttaagtggcacactccgtgactccaagcaattcaagcgcgtgggagatatctgaatgtcatgtaagtcaaaaacttgcacaaaattacaaaaaaaagttcaagtgatataggaccttagtttagttaaaatctgaaatttcgatcatagtctatgaggtacttgtccattttccctttgcgaaaatgaactttattgagttataatatacatatgtatttatatatacaggccgttcaacaaaagaagttgttcatcctcgattatcatgatttgttattgccatatgtgaacaaagtgaatgaactcaaagggtctgtattatatggatcaagaactatattcttcttgactcctcatggcacattgaaacctttggccattgagctaactaggccaccaatagatgataaacctcaatggaaggaagtttattccccaaataattggaatgccactggggcttggctatggaaattggctaaagctcatgttctttctcatgactccggatatcatcaactagtcagtcactggtacgttattacgtcacctaaaagatatttacatataagtctccttaagttattatatttatttttagactgttataacaagtaaaaagtgatttataatgtcggtgcatataacttgaactctttgctaacaatgacaacttttagcagtaataaatatacacattaacaaagagtcatatgtcattgaatcactacatcaaaaatgattattagcggtaattaattcttaattgctgctaaccttgaccgacattggttctaatgacatctaactaatgtctgtctctatagactctaggggcctttacgaagaatgataaaactattgccactaaagatcattttaatgtagttactcttcacattagtactctatcacgatgtcaacgcaaaaaaatttttttacactatcaagtcgcctaaaagatattacgtatagataagtcttcttaaggcatgacatatataatcttgaaaataagacaataccttttacaacaaggaaaggttgacttgataatgtaaaaatttcttaaactgacgcacggtgcatataacttaaactcttttcttagtaattatgactaattattttattttgaacaaaattttgcaggctaagaactcattgttgtacagaaccatacattattgcaacaaatagacaattaagtgcaatgcatccaatatatagattgttgcatcctcatttcagatacacaatggagataaatgccttagctagagaagcacttattaatgctaatggtatcattgagagttcatttttcccaggcaagtattcagttgagttgagttctattgcctatggtgctgaatggagatttgaccaagaggcactcccacaaaaccttattagtaggtaataattcactaatcttctattactctaattcgattcggtttttgatatctattttgggaccctactaacctaaattgattgtgacttgattcacaaaagggtagatctcgagacacgtggggtgttttagggttagaaaatcctatattgaaagtaaaatgctcccaaccaaaggtgattccgtttgcagatgttgaacttgagacctctaattattaagtttattttttattggggtgaaaagacaaataaccaatcttttctataatgtattcacaagtaacttctttaccctagcaaaccttgattttctaaatcatggtttctacattggtataacacaaacagaagattcaacatttactatatatacataaaaattattttgaccttatatataatataatttttcgacgaaaaggactcaacatttactatatatacataaaaattattttgaccttatatataatataatttttcgacgaaaaggactgagacaggaccttgtgcccctacttctactaatatgttattttgtgtaaaatttataggggattggcagaggaagatccaaatgaaccacatggcttgaaactagcaatagaagattacccttttgctaatgatggtttagtactttgggacatacttaaacaatgggtaacaaattatgtaaaccattattatccacaaacaaatctcattgaatctgataaagaactccaagcttggtggtcagagattaaaaatgttggacatggtgacaagaaagatgagccatggtggccagagttaaaaactccaaatgacttaattggtattatcacaacaatagtttgggtaacttctggccatcatgcagctgttaactttggccaatatagctatggaggtacacacaccttaccttttttcttttctttgcatcattttacaatttggccaaaataacatacgcagtatcagtatgatctcactagtggagtctagaaaaacaacatggtttagctaggtcaaaatttttgtttatgtatatatactataatgtcctttaacttggtttcaattgacttctacgctctccgattttgattgtggtcaagcaaacacttatactcgtatataattgaacaactagacacattcgtcttaagtgacatactacatgacaattttggttcctatgtggcttctgacatgtgttgtgccacgtaaaacgtgtgtgactacttgtacacattcaaaattagagggcatagatactagttgaagtcaatatgtattatgccctttttctattgtgacaattgatactccttagtaaaacttctggctctgttactagagaaggtagggcgtattatacagaccttgtttgtgtgagctaggtcgataggttgttttcgatagccgcacgctcggccctcatcatactaactattctattgcatatgtaggctactttccaaataggccaacaactgctaggtcaaaaatgccaactgaggatccaacagctgaggaatgggagtggttcttgaataaacctgaggaggcactactaagatgcttcccttcacaaattcaagcaacaaaagtgatgacaattttggatgtcttatcaaaccattcaccagatgaagaatatattggtgaaaagattgagccttattgggctgaggatcccgtgattaacgcggcgttcgaggtgttttcggggaaattgaaagagcttgaagggattattgatgctagaaataatgatagtaagttgaataatagaaatggagctggagttatgccttatgaattgttgaaaccttattctgaacctggagttactggaaaaggtgtaccttatagtatttcaatttgatttttttgtgtgtgtaaaagacataaattttgtaataaagtttcatgtgtaataaaaatgatgcaatgcatcatgtgtgctagctctttttgcttttgcaaatgctcgttgatgttgatacaaattagtcgtgtttgatcagtaatagatagccgaagggaattcgacatttactatataatacatataaacttattttaaccatgtataaataatataattttctgtcgaaggaggttcaatgcaatgtagctccgcccctggtttgatgttaacctgaacccaagtacattgaactagagatatcgggtaactctgtcatccgagatttaaatgagaagagttgaaggttctttctccaactcttcatgactcggaaaaaaatatattttcaaactctgtaactcagatttttatgtttccgaacttaaaagtagagtgttgtatgtttgtgttatgatgtctatgtgaaagagttgagtgcaatacaatgtctttagcgatgaaacatatcgtctgattgattcaaagattcaacattatgtccgacttttgtttatcagtcgaatttatatctacatgccagagacaaatgaaagcaaactatgatttgagtctgaaaggaagaaaagtcatgtctttattcaaaggataacaaatacattacgaaaacatcacagacgaatgaaagataaaggatttaatctgcatcttcaaaaactttgtcgacatgaatcctgcaataagaattaaaggtaagagcttttgaggatgaaaatacattgatatataaaaagttgaatgcctggaggtatagctactcactaatatcttttcttgtgctttttcattctcgtagtaattatgtgttccaactttaaatccatcctcgaaaaccatgctggatattgagttgaccacattatgtatattacggacagtccaataacaagtccacaaccgtaacccacgagaaccccctgccaactgatcattggtgaatcttcttcctcctcttcttgatctagctctgctggagttgtcacttgatcatcaacaccacaaagttttgagagtggaaa

SEQ ID NO: 502 - DNA, 4754 bp, Solanum lycopersicum
aagcatggattcacttgaatccaatggcctcctcctgagtacgcttttgtctgaatgattatttaaattgtaatatataattagttatcgaaattatttattctctcaaaaatcatcttatttaggtaaataaaattgtaacttttgaaaaacaaaccaaaaaaattgactaattaccacaaattaattaatgaccgttcaaacttcaataatcaattctcgatcccatagactagagataacgtacatctagagttttcttaaagttttatgcaaataagtctaataacggtataaactagctagaatatccaacacgaaattctcattgcaattaatagaaacactaaatttaaaatctatatgcataaattaatttctttcttaaattggtgtctaatgtctgcattaaagtttcgcttaaatttaaatgtctacaaagctcatttggcgctcccaacatactcagtactcaaactcgaaatatctgattaaggatgaagtaattctatcactacaccacgatcgtgttcgtgttggtacatggattaggttctccaactaacttttctaactgcaaaaacttttgagtacacttcttcatatatgtttttgatcatcattaaattttagtactcatccaataactaacataaaaataatgttttcatcttttccactagcttctttaatttcttaaaaatagaagcaattctttttctcttccgaattctctaaactgaattttttgctttatacaactgaactaaataaccttatcttctatcaacttcccataaagtactctttagctttcataaaatatattccagccaaatttagtaaaccaccaccacctttaatttaatttgtaacttattaaaatgaaatattactatttttagcaagtttcattatacaccagtcactataaatattggccccaacaagtgaccaatacacaagaaacacatacgtatatacatgcatttgtctatcaaaataataatggcttattttcaaagactaattagttgtatttttgtgcttttccttttgtccttagcttttgcatgtgaagctagggttttacttgatgaaaataatgcaaatgatcaagggtttgttagagtcaatggtgcacattttgaactcaatggatcaccttttctattcaatggtttcaactcttactggctaatgcatgttgctgctgagcctagtgagaggtacaaggtctccgaggtccttcgcgaagcatcttctgcagggctttctgtatgccgtacttgggcttttagtgatggaggtgatagggcattacaaatttcacctggtgtttatgatgaacgtgtttttcaggtagtacatttgtttgtgtcatttcatatgacattgactaacacctttctatatttgaaaactctttatactaacattgaacttctacctataatgttatatgtttttaaaatgacattttaacactacaagtttatctttttcaacttatgaccacaagtacttttaatgaaggtacttttgatacgtaaaagaatccatttatttcttgaactttgtatacagtcaaacaacatattactacattatgtacattatgtagggtttggattttgttatatcggaggctaagaagtatggaattcgattaatcttgagctttgtaaacaactacaacgattttggagggaaagctcaatatgttcaatgggcgcgaaatgcaggagctcagataaatggagacgatgatttctacactaattatattaccaaaaattattacaagaatcacattaaggtaacaaaaacctagcactcattaattgattaacacatgctaatgtttaattttaattattaagtacaattattgttaatgcagaaagttgttacaaggttcaataccattactggaatgacatataaagatgattcaactatcatggcatgggaactcatgaatgagcctaggaaccaagctgattattcaggaaatactcttaacgtacgtacgtctgaattaaatcatgaattgatttctcaaatgctcactcgatcaactgattaattataagtactagttattatttcaaaaagtaactattatttgaatagaatgatcatatgagaaatcaatcctaaataaaagagattctttttatatttctcagttactaagtacattttaaattcaataaatttgcataattgatgtttatattttgatattattttaggcatgggttcaagaaatggcaagttttgtgaaatcacttgataacaaacatttgctggaaataggaatggaaggattttatggtgattcagtgccagaaaggaagtcaattaatcctggctatcaagttggaacagattttattagtaaccatttgatcaaagagattgattttgccactattcatgcatacactgaccaatggtatattatgttattctttcttcatagttcacatacttcactcttatctttggttcgaatcctagatttgaaatttttttatgagtcttgcagtacgccctccggatttaattgggctaaaaaaacactaaaatcatgatattgatatattccctccgtccctatttagttgtccactttaaaaatgacacacataataatataacaatagttaacatagtgaagttacaattttatccttattaattatggtttcaaatttcaagatttttaaatgagggtataatagaattttttttgatcctttcttgatttgtcaaaattgacaaataaataggaacaactaaaagatgaaatatggacaagcgaataggaacatagagtattatttacacgacatcaaatcaactttattcaaaatttaatatttaatgaattctgtttataaggttttcaaatactgaacataatgagttttcgaaattgtacgtccaaaattttatgattcaagaattcattccacctttggactaacaaaagtatcacgtatggcgccactttttataatataagaaacccgttaatgtcaaaataaataaaagttcaatatatataacatcacccatatgttacgttatctagtgacataatacctagttatccttttaactgtttttcttttaaaaaaattataacaagaattaattaaaattttttaatgctgaattataggttatctggtcaaagtgatgatgctcaaatgatcttcatgcaaaaatggatgacaagtcattggcaagacgcaaaaaacatacttaaaaaaccactggttctagctgaatttggcaaatcaagtagagatccaggatataatcaaaatatacgcgatacatttatgagcacgatatatagaaatatttatagtttagcaaaagatggaggaacgatgggaggaagtttaatatggcagctcgttgcacaaggcatggaaaattatgaagatggttattgtattgaattgggaaaaaatccatccactgctggaattattacaagtcagtctcatgccatgacagctttggctcatttggttaagatttaggactaattttataagtaatacattagaggacatggaagaaaataagtatactttagtagttccatcacctttttttttttgggtaaattatgaaatatgtctttgtaataattggctaagtatatgtaactttcaaataatcaattgaaatgtatgttttaatccttttatatatatgtaaaatttatatattttcaactatttttagagctatatcatttaagtggctattgaggaaaataattagttctatgagagattctaggtactcacgttactataacaaaaatagtttttagtagcaataaatatttatattaacaaagaggattaaagtcttatcgacatttgttaattgtcactagattcgctatagactttatggtaattcatagtcttaattgcctctaaaaaacatatttaatagcaattaaaatattatcaataattaattaatcaccactgcttttttttttaaaaaaaaaagcaaaacacttttttttgttgtattgtcaaaaaaaaaaacttctagaaagggtatatgtacctaagcttcacaatcaaattaaatgaagggaaaaagaaaaagaaaactccccagcctaaaagaaaaacatagtacattaagcaagaaatacaaaagtcaataacagcaaaacaaaatgatgagaataactactcgctttgtctcatttgatataatttgaattttaaaagttaaataatttatgcttaattgttaatttgactgtacaatctttgatttacgtaaaaagtattataagttttgaatattgagaagttgaataatatgctttgcttcatctgtaaaatctgaaatttgtcatgaaatcccagctttgtctccaagtatacgaactctattgggaaaatgcacaagtaccccatcaacctatgcccgaaatttcagagacacacttatactatattaaggtcctattacccctctgaacttattttataagtaattttctacccctttttagcttacgtgacactagtttgaaaaaaaaagtcaattatcattgggcccacaagatagtgccaggtaggctaaaaaggggtaaaaattattaataaaataagttcaggaaggtaataggaccttagtatagtataagtgtatctctgagatttcgggcataggttgagggggtagttgggcattat

SEQ ID NO: 503 - DNA, 3686 bp, Solanum lycopersicum
ttacggaagatccacgaagaaacatatatttatgcttgatggacttagttaagaataaaattcgcgtttactatcagttatacgttgagataggctgaagtaaaaacttcaaaggacaaatagattgacatcctcaaacttgattataatataattatttgattataatataattattgtagcgggtaaaattaatacgtgtcttacttaacacgctaaactaactctatagtatcgtgtgatccatatgaggcgaaactaaaatttcaattttatgaattgtgaatttgataataataattttaagtgacaataattaacttctatattcaacatttatacgtatttgataaatttacgaacataaatatactatttaacaaaatttattacccccgggccccgaggccccacataaatttatgttccgttactatatatgttgatataatttttttttctttcttaccgaatactaataaaataagtaaaaaaaatcaacttttttccacgaatcaaactaattgatgatttaatatatgagttttggtatttcattattactactagtttagtgtacatgttttgcatttgtatttgaaattaaaatttatggaagagttcattgcattaaattaaatataatactatgagtacacgtttccattatattatttcatcatcaaatccacactcaacaaaccttaaaaaccaatcaattaatgttttccatatttttttctttttcatttaccctataaaattctttcaatagacctatctttctatcttaactaaataactaccttaattctctatcaacaaaaaatcaacatcccatcataccttttaagaacaaaaacatttttttcaaaataaccaattatatccactaggattttattttttttagtttttgcaagttttgctatttttagtaaatttccttatcttcaacacactataaaaggtgacatctaacatatcacacatataacatctattattcattatacaaaatgtcttatacacatagaagaagttgtatttctgggctctttctcttgttgttagctctttcttgtgaagcgaattcggggtttataggagttaaagattctcattttgaactcaatggatctccttttctattcaatggtttcaactcatattggttgatgcatgttgctgctgaccctgctgaaaggtacaaagtcactgaggttcttaaagatgcttctaccgctggtctttctgtttgtcgtacttgggcttttagtgatggaggtgatagagcattacaaatatcacctggtgtttatgatgaacgtgtttttcaggtaaaggacatttgttgttatagtatcaatgatttttttttgcattgtcgcatttcaatgcatgtgagtcccttacttgtttctaaatttagggtttggattttgtgatcgcggaagctaagaaatatggtgttcgtttaatattgagctttgtaaatcaatggaatgattttggaggaaaagctgaatatgtgtggtgggcgcgaaatgcaggagttcagattagtaatgacgatgaattctatactcatcctatactcaaaaaatacttgaagaatcacattgaggtacatatggggtagttattatttaatacatataaacaacttttttttataattaatattatgaaattattacagaaagttgttacaaggttgaatagtatcactaaagttgcttacaaagacgatgcaacaattatggcatgggaactcatgaatgagcctcgcgatcaagctgactattcaggaaaaactgttaatgtaagtttgaaattcaagtttaattttaaaaatatcaaatctataattgacgtttttgatgaatattgttatagggttgggttcaagaaatggcgagttttgtgaagtcattagataacaaacacttgttggaagttggaatggagggattttatggtgattcaattcctgaaaggaaattagttaatcctggttatcaagttggaacagatttcattagtaaccatcttatcaatgaaattgattttgctacaatccatgcatacactgatcaatggtatgtagaatttacatgatctttcgaatctgtacgtacattttcataagtttaaatatttatttatatcgatggttataggttatctggacaaagtgatgaagcacaattggccgtggatggaaaagtggataagaagtcattgggaagatgcaagaaatatattgaagaaacctttagtgcttgctgaatttggaaagtctagtagatcagtgaaggatcaagagatatatttatgagtagtgtgtacagaaatgtgtataatttggcaaaagaaggtggaacaatggaaggaagtttagtatggcaactaatggcacatggaatggagaattatgatgatggttattctattgttttgggactaaatccttcaactacacaaattatctcaaaccaagctcatatcatgactgctttggctcattctctcaatcatgagtgaagacatcataataatcaatttataatctatcatttttagtattattaatttgagatgatattaccaaacatgttcaagttgattaaacacaagaatgtaattgaataaattgttttagtaaaaaggaaagttatgttaatatgtccacatgtttttattttgagtttgaaagcaaagatcaagaacactaattttaatccagtggaaattcacaaagtaacacatgcaattgtattgttatcaagcatatatacaaacaacaaaaagaaaactaaaaaacagaaaagtccatcttctataccttttcattttgttgggataaatgccttcaaaaagttgggcaaatcattctggcttacaatatttaaacactaggctccacacaatagttccaacaactagtccactgttgtagcctatgactactgattcccacgtaaatcaactaaaaaaatatgactcgtcttccgactctagtggttgaggaacatgggatgaaccactcgttccacatagattaatgttaccgcagtacaagtcattttcaaatgtgttgaattgtagaccgtgaggaatcgattcaataagaagattctgagagaggtttaaggcggctagaaataactttacagaaacacaaagtaaccaaagtttaaccaatcaaaacgttaaagatcaagccaatgatctcaatcaccagcgtattgatactcaaaactctggtatcagtgaaccactcaacaacaataaattacacaaagaaacgtttctaagtcctaagccgagcgagtgacgatgacggctcgagggggttcctctttccaacacttttaacaatttataagagtgactctatatttaaactctcttgtttttctttccatcaccaatgagggacaaatgtcttttcactaaagcataagaggacttttctagttccctactcttcaagttctcaacttcccaagttgctcttcttttcatcttttgatacatacccaacagttccacacatgaatggagaatgattataacagaaggaatgcacggaaaaatgtgtacattacaagaaaggatcaattgcatctggataagtaggttttgccttggactttctgtagtgaacatatgtcgaacat

SEQ ID NO: 504 - DNA, 8570 bp, Solanum lycopersicum
atgaggttttatcttaacagattttaaatgaacttcaataaaaaaaaagtgatcacatttcaaaaagtgcaagtggtaggaaataagggcattgagatgttgtatggacatattatgagtgataagataaggaatgagattaatcagaactaagtaggagtgacctccgcgatggataagatgaaggaagggatactgagatagtttaagcatgtgacgatgaaatgtgcaagaggttgatataatagttaccaagagcatataaatgtacacaaaagaaacattgagaaagaggtgtttggattgaatacgacacattttcagcttatcaatgacataaccattaatataagaatataatggagatcgtgaataaggataaaaggttaatggacagtatataattatttattactagcttattcatatattaggcttggtggtaatatagaggctttaacaccatatctttcttagtaagcctattcatgaagtctttgacttttggtatttgatatttaggtaatcttataagtttctcgcatatatgctccatactacttgctattacttgtcatatttttttttactattatttttttaattacgatttaaatttatataaagtcaaagggtctctatctcggaaaatagtgatacattttaacctttgaaatgtcactatataagatttcaccgaatatattattattgcatttctattataattttatgagaaagttgaaataaatataatttagactcattacaaataaatttagtatattttttttcgaacatttcgcttgatagagattagactgattttaaaataagaattatataaatagcaaaagcagttattcatataattaacgagatgttacacacttttttctatagtcaatttagtgtacaaaatgaaaacttcattttcgagaaaaaaacatgtaaagaaatatccaaaaatataaacatttttgtctttcttcatacaaatgccatttttttttgcatctgtgttttctccatcttcaacactgacgcaaaatttgcagaaagataaataaaaactcagtaaacgtctcttgtcttcatcccgacgcttcggccatctgtagagccacaacaaacaaacagcaatagaggcatccaattgtgcgcaccaataattaatcaacagtagtattacaagtcaattttatattattaatttcagatcaccttttctatgtattcaggtttttttctctttcttcatttatctactcaatcaattcaattttctctcgaaatcctaatttttgagctttctcgtttgatttattatagttgttattcggagattaatggcgactacgcctaatacgatgtcgattaagcaaggtctttcactctggtgtcctcaatcagctgtgttgaatcggatttcaagggtttcggttccttctagaagcttcaggagaagtttcgttgctgcttcatcatttgataatgagaatcgagagtgagtttttttttttgattttgatgtatttatgtttgatgtatgtgtaagttggcggatttgaaatgtggatgattttaggtatgtggtagttggaggaggaaatgcagctggatatgctgctagaacttttgttgagcatggacaagctaatggaaagttatgcattgtgaccaaagaggttagttgaatagtcactatcgacctctggttaattgtatagcaaaatattgtaggcgggagttgtttttgtgtttttagtacatttatatgttgttgatgagatttgtatgttagtgtagagataagtgtgaagtttagagactctctagtgtaagagaactctttagttgtcctcaaggagaaattattgagtattagaatggaacagcccaaaggagcggaatagatatagaggatttaagtagttgaacttaacttgtttggcatgagagtgtagtaagttgtttttttatattttattgagtattatttggaacgatgagtggaatacttgtaggtagtcatgcccttttagctggtctaattgtggaagctgtataagaaactaattgaatggatgcttaaaacgttaggttaggatctgttattttgcttgagttgatttcatttgaaataaaaagttccattttgtgctaatgcagccatatgcaccatatgaacgtccagcattgaccaaagcatacttgtttcctctggacaaaaagccagcacgtttaccggtgagctttaattgatcattttagcattaaaaatgtctacatcttctcgtgtgatatttgcaacgtcgattgcttctcaattattgttaatgccaattcagcatgtttttgaggaataccatttaactgtataattttagggctttcatacttgtgttggcgctggtggtgagaggcaaacacctgattggtacaaggaacaagggatagaggtaatgcatttttgtctaatcatttgtacaagtgtgatataattgtgatgttctttggtttactgaaaggaaagcaaggtaaatatattgaagatttgagaatatagttaccagttaggttccaggacggtttgagaggaaacacactctcattttgttcttactttcatttctttattcagccccagcattctaactatcaagtaaatctatttgaagataattgtttaccctttttcagatgttgtatgaagatccagtaacaggaattgatatagaaaagcaaactctgacaacaaattcaggaaagctgctcaagtatggcacccttattattgcaaccggatgtacggcatccaggtaacattgcttgctatactagagtgctgctgatctaaacctgttatttattttgcaattggaattcgtattgatagatgaaacgattagaatttgcactcatccactagtgccttggtccaataaaaaagaaggatcagaataagtttttttccgctttaataagtctcatatattccatttactgtataagtttattgctctaatttgtatatactggtatgctcttcaatcctgattaaagtaccaaacagaataatttagtattaattgacatcagatttcctgagaagatcggaggaaatttacctggggttcactatattcgggatgtggcagatgctgattcattaatatcctcactggtaagatcgccctcattccgatgcttataattggatttctaaaatttaaatatacattacataacttttatatatggtgatctacttggtgatatgcatgatattatttctaatctatgttgttttattttaggggaaagcaaaaaaacttgtagttgttggtggtggttatataggaatggaagttgctgcagctgccgtagcctggaaacttgatacaactgtgagtttccttaaatgctttttcttcactatgctaaataagaaatgctgttctttttatgaagaaataagaaatgctgtttgtgagaaaataaataagaaatgtgaatcacaaaccatgtttaactattttgtttataaaaactaaattgcacatttggtgggaaagtctccatataagcaaaacccgttgatgatcacatgacgaataatactatatatgtaaagttccaacatatctgttttcttctacaagtcaaaagaagtccatgttcctttctcggtctgatgagtcctctgttcaaagagtactctgaagcatattatccagtttattaccttacaaatgaagtattcaatttttcttattcctctgagatttaaaacttgcctgcatatgaatatcgtaccagtataatccttattttactaactgtgttgagaacatagataatttttccagaagagcatctcttatcaagactgttcactccttctcttgcccaaaagtatgaacaactctaccaagacagtggtgtcaaattcgtcaaggttctccatcctctttcctctctagttcgattgtcatatacctcctttatcaacctagtttgttagcttctaattgaattttatcctttcccagggtgctaagataaaacatctagaatctggtccagatagccgggtaactgcagttaagcttgaagatggatcaagtatagagacagacacggtaaaacaacaatttttatgttcttaggaattcttattataaccgaggattggaatatattatacaatagtgtggataaagaagttgaaagctcaagtcatttgcatatcctttatgaatttgcaggttgttattggtattggagcaaaacctgccgtcagtccatttgacatggttggcttaaacaacactgtcggtggaatagaggttagcactctatttatctctatgctaggatttatctagttacaatttacggctaaccactcctaattgcaaaatttttatgatcttccaccaattcatgataccctacaagttggaatggcaaatcaaaaatatcttttaccttaaagttaaatatcgatttaatcagttctggacaggacgacactatagatggttgattctattaagattcagatttaagtccttacatgtgtgtttttttatctggttagcatgtttccatgaagtacatttattgtattgtctacaagaagtcttaattacatcagaaagaaggcatagtctaatacattcaaaggtgggcagtgagttttgttcccattccacgagttgaaactattcatgttcagagcaaattgctctaactcatacttgagctattgttttgttgctaatacacgcatgtagatctttgagtttatttgtttcctctgcttcttatccacgaaaaggaacaaaaagagggaaaagaaattttcattttctttagttttccagttgaatggtgagaaggttataaatatggttatattactcctgatcaatatagctcttttgctgtttgacaatgaatagactgtagtaatcccaatgaggaagttggttccagtaataaaagaggatgttttaagtatgccaaatgatatgaactcgtctgtaacttcattccttttagtgttgttatctctgggcataactgataaatctgatggtgcttctttctattaacataccttcagaatgtaagagcttgatctttcctagaaatgattacacttcaatatttaaaattcaggttgacggacagttccgaacaaacatacctggaatctttgccattggagatgttgccgcatttccattgaaggttagatcttctgactaacttcatacaatttttattttatttttgtgtaatgaactgaacgataaccgtgcagatatacaaccgaattgcacgggtggagcacgttgaccatgctcgtaaatctgcacagcattgtattaaatcattgctaactgcacacacgcacacgtaagttaatttaagttctgttcataagcaacgataaacattttttcattcaatcttcctaattcttttattatttcctgaatgcaggtatgactatttaccatacttctactcaagggtttttgaatatgaaggaagctctaggaaagtatggtggcaattctttggtgacaatggtaagaatatttttgttttgcttatcttgatattgtccaactatttctataaacaatttcataactggtattgattgtaccatcttatgaacagttggggaggccgttgaagttgggaattttgatccaaaggttgcaacattttggatcgactctggtatgcactctattccttctttttgtgtgtatatggttctgtaggttatgtttcttccccattcctttctttttcgggagctatacttcaaaaagataatactaataaatacaaggcaaaagaagagtgatctaaacatacatcttttcaggtaagctgaagggggttcttcttgaaagtgggagtcctgaggtatgcactcttccaaggatgttctcatgtcaaatttagtagctatctgtaatggtgttctatgtacatatatatgcaagcttcataaatatcttctatgagtcatcaaatgttttccttgcccctctctcttgacctttgaaaccatccctccaaaagcctaacgaagataaggtgacttgtcaaggaagagtgttcattcatatccaggaagtgattattatttatataatatactataaagtaagagatatatgaaaaaaattatagtcgtccaaagtgaagtcgtgtatgtgtattatatgcatgcttctgtgtgacactgtgaaatagccacggttacctacgtttgccatatttcttacttccatctacaagagttcgtctctgcttttagcttaggatgcatttggattctgtgagcaatttttcctgttaatatgatgctactgaaacgatgtaacaggacttttcacttatcttttcttgtatatggaatttgggggtacacatatagtcgtacacaatatcaatacttcatctcggggaagtagtaatgcatgtgctcacttattgttgaaggaagctcagagaaaatagggaagttcaatggtagagttgatagtttcacctgttaggaattctggaaaaaaacaaaatagtttctgttctctatagacaagtatatatgttttttttgcagactacatagatgtcaaaagctcaaagacttgacttgtttctatctatcatgttgatggctttgaactaatgttaagctccaggaatatataaaatcatactataataacataaaggcccccaccatatggacattacatcattgtttgaaacacttgcttctccaccataacccattgcgcccctcccttcatcctttctgaaacagcattgcaagtatgaacttgtctttcctagaagttcactgatcttgttgaactttcgcgcaaagaacaatatgttctaaatattctccccattttgactgtctgtattgttagtctgtacttttctttctggaagagaaatgattgtaagtttgtcccttacctagaaaggcaagattttgcttaatttatcccctattgctgtctttaccaaataatctcatcattcagtgaaaacatgatcgtcaacgatttctcgaattgtttcaggaattccaactgcttccaaaacttgcacgaagccagccctctgttgacatagccaaacttcaaaatgcatcgtcggttgaagaggctctagaaattgctcaagcttccttgtagattgaagctgcagtttgattaccagttcaatcaagagcatcctctcacacagtacacctatttttccagattgtggtatcgaaatacccatttggcgatttcggcttgtaagattgagagagggagagagaggggacagcgtattggatttctaataaatcgtagaaaaatggatgagagcgagcgggtgtgggcacttgtttatgttggtatattagatgggtaataagaatgtcacaggcaaatggatttctaacatgaatccaaatgaatcaaatatacaatatcttaaagttaattttaattaagtctcacttattatacgtgggcttctgcttctaagttttatatgactaaagttcaaatagatatatgtgatatgactggatttttattatctttgtttgatccatatgtgtatggacttcaaatagagatagctaaagttggacaaaaatagttctactgaatttcagtcatttttaacttcaaatgttttgttgttgaatctaactttagatatcgtatatctaaaacatatttttttggttgaaagttttaccaatatccatatggtccaaagagttcaactatggaacaatcgtgtatgctccacttatttatacgacccattcgtaattctgagaccacctttagagattgaaatttaatatttatatttcgttaattcctatttaccttttagactagaacactaatatccacatatgtgattgacttggtaaaacaaaaaaagtgtttacccaactactaagtcaaccaaatatctcttcattttttttccctaaagaaatttactagtagtattttaattcaatgcctcatgtacattcttattttatttcctgttgacttaaaagtttgttatacaactatcaacaatattctaaactatatacgctgtctgaaaacttgtaccaagtcaaaccaacattaaaattttatggaagatgaagagaccagtaaaaaaattggttgacttttactttcttcgattcagtttacttatcatgttttgtctttatatgctcattaaaaacgtgaattaaaaagaataattggattaatttgatccatagacgagtatggacgtacaatagaggaaattaaatgtaatacaatgaaaaacaaaaactatcagtaaggattgataaatttagtaaacaagttatagcatataatttcttgatttttagatatctttcgtcgaaagcttagattatatatgtataataatatgaaatacattgatcgaaaaattgtttttgtatttatatattaaattttggatattcttaatta

SEQ ID NO: 505 - DNA, 4919 bp, Solanum lycopersicum; identical to SEQ ID NO: 447

SEQ ID NO: 506 - DNA, 3977 bp, Solanum lycopersicum; identical to SEQ ID NO: 256

SEQ ID NO: 507 - DNA, 4237 bp, Solanum lycopersicum
aattatttgcacaatcaaaacattagaatataattacaagtaattataatttatccgcttaagggttgttttatagctactttagaggctagatatattcaaactaaatcttgcatgagttatattacgtttgattatgtactatcaaattagtacttttttttattgcaatttagaaatcgatgatgaaacaatgatttccaccaattgattcaaaatatgaaaagaagtcaataaaagggttaaacattttagagctattataaaaagatagattcaacgtctatatatatatatatgtatatataaaaatattttcccttaaaagatgcatggataaaagcccttggctctatgctttgcccctgcgcacaaataatagatatataacatataagttaattatgagataatctatataattgaaattaataatagataaattctcgcataactgatctttacaaaataaaagagatttatataactctaaccagcaactaaaatatttaagataatacttttcacattattattgatatatacaatttacatctataataaatttttcactacaatacaaaaagttaaaaccaaaagtttacaaataagtacatcaccctcctcacccctaccccctctctacccatactcgtgtggttagtagttgtcacacaactcacaagtctctataccccctactcaaaatggtcattttcctcctctctctttctctctctaggcttatcgatatgataataagggccttagcttagcctatagcatagtacagtacagaaagatcatcagagctataaaaaaaattgaaaaaaaaaaaaaacagaacaggacagggcagttgtacagatttttccttttccccacctacatcatccatccttatgatttcctcccactctaatctttctgcaattcccatgaacctaacgtacactaccatctctcctataatataaccctcaaatcactcaaatttctcaatttcataagaatgtgctgtgttatctttgtgtgaaaattcttgaaatattaggtttatctatttcgtggtgttagccttttttttaccatggagatttatcatcagatgcagtttgattgcggtgatccgcatttaccaccggggtttcggtttcatccaactgacgaagaacttattacttactacttgttgaagaaggttctggactgcaacttcactgctagagctattgctgaagttgatctcaacaaatgtgaaccttgggaacttcctggtatgaactttttttttttattctcatgttatatttgagtgtgcaaatttaccatgttttacaagatttgaacgctaattaaatattttaacatacttttgagctttaactaaaaaaaaactaaaatacccttattttattaagggaaagcgaaaatgggagaaaaagaatggtatttcttcagtctacgtgatcggaagtatccaacagggctgaggactaacagagctactgaagcgggttactggaaagctactggaaaagatagagaaattttcagttcaaaaacatgtgcacttgttggtatgaagaaaaccctagttttttatcgaggaagagcaccaaaaggagaaaaaagtaactgggttatgcatgaatatcgccttgatggcaaatttgcctatcattatatctccaggagttcgaaggtactagagtatttttgtgttaataattaactgatacacatatattaatgaattttgatgaagaaaactgatctacatgttttgtgttacaactcatacttttttttgtatttggattaaagagatcagatttactggagatattctgtgcacaaatatatcattgatattactgctagagccagagattctgaagcagaaagttttgtgaaacttcgttttcaatgtctcaattgcttatgattaagttggaagtatacatagtctgaaaaataacagaaaaacaaattaaaagagaaaaaaaagaatttgcttttattatgatttatgatcaaagcaattaagactttacagaataatatactgtcatattgatagcgatttaatataatctctttccaaacttattttattagccttatcaatgtgtaagcatgcttacgtaaattcatcagtctgttagattttgacttttagcgttttggcattaatttaaatgcttctttttttaaaattgcatcataatgagcttcatatttgttagattacaaacatttctttaataacaaaataagattcgtagacgctaaaaattaggtcttgccccaaaaaatgttgtatatttgtttttcatggtaaagttaaaagcctgatgcgggttttatgaaatttgtagctttcacaagttcataaaatatgtaaacatgcttgtagttataaattttaaattttgaattcgttttttcgtgtttccattgttctcatatattttttggctacaggacgagtgggttatctcgcgggtctttcaaaaaagcaccggttctaatggtgccgctacttcaactggtggcggcaaaaaaaggctaagttcaagtataaacatgtaccaggaagtgagttcaccgtcttccgtctctcaccttccgccgctcctcgattcctctccgtatagcactaccgccacttccgccgcagctatcgtaatcggcgaccgcgatcgtgatcatagcttcaagaaggagcacgtgccctgtttctccacaactgctactgctacaataactgcacagagtctaactttcgatccaacttctgtcttcgacatttcatcaaacaccttgcatgcactacagccaactccaagtttcgcttctattttggactcttctccatctaatttcactaattacacaaggaattcaacttttccaagcttaagatcactccatgagaatctccagcttccgttattctccggcggaacctccgccatgcacggcggattttctaatccgatggttaattggaccgtgccggagactcagaaagttgaacagtctgaacttgactgtatgtggagctactgaattagcaagtgcttaattttaattaagacgttaattaattaagtaatcagtgtgttaatctttgctttttgtttagtatgtactgcgtgtggcagctttagtggtattgtcactttgttgtaaacgttcagcgtaatttaatgcatgctattatttctcgactacattagtacattattataatttaacgtcgaatatttactatatattttaaaaatattaatttgttataattatttcgattttatctagctttgcacgtgggatggggttactggtgctgattaaattatgtggactaagagttaggatacacatggaatattgtcggtgtttgggaatgagacaaattaaattgaatacacttgctttctcttttaacttacttacattatgattttttttgtggcagtttatatgataacgtatatttggtgttttacgtacgaaaactctgccagtatgtgtgtggtgaagttcttagtaaaattcataattacctaacaaccaaatgtgtgttcagtattaaatcataataacaggttgggataaggcagttgctactagatgcaacgaaatagagagaccaggccagtgagttttatctatgttttcatattagatatatattttttgggcactaaatcaagagtgcaagcgagatgaagataagtgaacgagattttcatatatatatgtgaatttactttgatacaatatatctaaaataaattatatttaagtttgatctcatatatttcgaaacatatatatgtggatatactgaactcttaaaaaattcataatattccaaaatagtgcatgtctaagtaattagctataatagtgaaatttttattagtttctcatgattccaaatattttagatgaaatttccaacgttgtcaaatcgaggttaatggagaaggaagtcacacataatctccatataattgcaaatacattgaagccatagtttgaaaggtaaatatctaaataccctctcttcgcgctaaagaaaaatctcgtgattatgaaatcatattataaaatattcttagtcagttcaagaataatgctatgtagcaaatattatcaatgtttgtcctacttacaaatgtatcaacattgttaagtcttcacatacttgtaaattaaattt

SEQ ID NO: 508 - DNA, 4818 bp, Solanum lycopersicum; identical to SEQ ID NO: 336

SEQ ID NO: 509 - DNA, 5713 bp, Solanum lycopersicum; identical to SEQ ID NO: 337

SEQ ID NO: 510 - DNA, 5779 bp, Solanum lycopersicum; identical to SEQ ID NO: 338

SEQ ID NO: 511 - DNA, 4877 bp, Solanum lycopersicum; identical to SEQ ID NO: 340

SEQ ID NO: 512 - DNA, 7044 bp, Solanum lycopersicum; identical to SEQ ID NO: 342

SEQ ID NO: 513 - DNA, 7519 bp, Solanum lycopersicum
  modified_base (7162)..(7391): a, c, t, g, unknown or other
atagaatccattcattttaatgggagggcaatttttttttaagcggattcaaaatataaaaaagtaaatatacggacaaaaaaaaataagaaaatttatcaacgtatacataagaaaagttgcatacttccaaatagacatgatacataaacatgatctttaacttgacgtcagttggcaactatatgtgcacaagtaggcacttaaacttgtataagattgaacaattgacacattcatcctacaggcaccctacatgaaaattttgtgtcctgcgtggcgtcctacgtgtatcatgtcatgcatgacatgtgtggctacttgttcaattttatacaagagtaagtgcctacttgtgcgcatccaaagttgagggtcatagttaccgactgacgtcaagttaagagtcatgtttatgtattatgccctccaggtaacatagatttgaagaagcatggaatgcatgtagatcttacttctcgtgaaaatggttttcaaatacgaatagattagtctcggctcaagtaaaacattttaaaagtaagtacttaagacaaaataatacaataataaaaaagttatgataatattaaataataaaaactatagcaaaatataatatattatcgaagcaaacataaatgtctaattcaagcctcgataaatgaaaaaaataatctaatttgaacaccgcaactttcttttaaatgggccctccacgacactaatctagattaatcgaaataataaattctgaaatacctcatgatatatagtaaaacaaaaaagtctttattctcttttcttcttgactagggaaccattagattttaaagacattaaatctattacccttaccctaagaataagaagatgtaaagtagaagagaaaacaaccaaaaccatatatatacatatatataattacattatattgtcttataacatatagtcttttaaggaaaaacaaatttagaaaaaaataatattattttacattttttttcttcatacaatatgggtagagggaaagtagaattgaagagaattgagaacaaaataaatagacaagttacctttgcaaagagaagaaatggactcctaaagaaagcttatgaactttctatactttgtgatgctgaaattgctcttattattttctctagtcgtggcaagctttatgaattttgcagcaattcaaggtatgtatgtatttttattgacataattttgaagattagagatgtcatattgtttgaggtactatttgtttttgtatatatatatatatatattcactatctggtacaaaggtttgatatttcactgtctgatgaaaaggtttgatttttattttaatgttattttatgaaaaagatttttattttgaaaattagaaacgtcatatcgtttgaggggtactatatttttttttatatgttttactctttgctaagaaggtttgatctttgattattgctatataaagaaaaagagcttgatttcttgaagattagaaatgtcatatcgcttaaggggtactattttgtttttttatatgttttattgtttgttaaagaaaatttgatctttgattaatgatgtattaagaattaaaaagatcttgatttcttaaagattagaaatgtcatatcgtttgaggggtattatgtcttttgtatatatatggtatatcgtatgctaagaaggtttgatctttgaatatactatattatgaaaaagatcttgatttcttgaagagtagaaatgtaatatcgatagaggggtatctgtgatcgcatatgttgatctttaattgatgttattttatgaaaaatgattttcattttttaaagattatactctggtaataaagaagatatgatctttaaaagaattttgatttcttgaaaattagagatattatatcgatcgaagggtataacaatcgtatttgttctactgtctgctaaaaaggtttgatctaagatggatgctattttatgaaaaataaaaaatatttaaaaatttgaatcgtcactaatattatatttatatttttaatctgtgtatcgaggattgtttcttatcgtatatatgatcaaaactcaatttttttcaaagattagagaggtaagtagtactatttttctatatttagacttttgattgaaggatgttgcttatcatatttatggtaggagaaaaaaaaatgattttggactaagttttccatatactttgactttatcatatgttgaaatttttgtcaacaaagaaaatattttattggaacaaacatatgatctaggtttttaaagtagattatttcaaattaattataccattacaaatgaagaatcttgatgaatttatatatttaaagataaaagaaataattgttataatttttataaggaataatatatatgttagttgaggggagtctttaactttggtgttgatttgatgtgcaccttcatatttctccattttatgaaactttatttttcttaaagtacagacatataataaagacaagcgtgacaatttttcatataaagctgaataaattcttcatactacattataagcaaatagaatatatctagatttgatcatcatcactagtattgaaataaatcacttctttagtttactttttaacgataataatcgtgatgaaatagataaatttattcattcataacaaaaattttcaaattcgaattttgaggtgataatttatgtggaatattctaaaaaaaatcaggattaaatttatatgaatatctcaaaattatttatcttatatgaaaatggtgaattataattaccatgaccaaagataaataaaaaaggaaaaaataactaatattatctttttcaaactttcacaaaagtaatagggatcaaatcaactagtagtagtacactttatcatgcataagaaataaattgttccaaatttatacttatacaatattttgtcatggtatcttgtagtctcctacactattattatcattataaaaaagtaatacaaatttcttgattttccatccggtgctccgttttgatttttagagtatcgtttaatttaaattgtatcacgtaaaagaaaagcactttcaatatcgttataatttttttttgttttcagagattaaattcaagtcttttgattcaaggaaatgattatgagatcctttgtgttagacatgtgaatttaggaagtaaatgattattagacaacaccatgcataatttatgagcttatatttagcttttaaatataagttatttttagaaaaaacttagacaactaatttgcaacgatagaaatacaattttagagaaataaaatcatcataaaaatataggaaaattaggaaaattaaacatcaattaatgaaaaaaaaaggaagttaaatttgtgggctcgagggagtaattaaagtagattaaaagttctttttctgaattttacctgccctttgttattacttttccttttttttttttactttccatagttaatttcctttcgtttatttttttcaaaaacttttacagtaaaacaagtcaataaatatttatttcgctataaatcatttcataaagatgaaaatactagtactagtaataaggaatactaaaatgtgtggatttccggggaagttccaacgacacgccattaaaagttattttcaacgaaaatataatcaaaacatttttatttccatcggaagctcacatatttttttcgtgaatactcttctttacattttaatttgttttttttatatcagttgagcacttcgttttacaaaatgatcatctagacaactttgaaaatttttgtgtcacataagcatcaggtgtctaggagatacagtaaaaacgagttggaatacttagttgtcaaattgagatcaggttaaaatgtttacatctgcactttcaaattatattaaaacgtatagttgtcagctgatatcaaattatattaaaacgtatagttgtcagctgatatcaaatttaacgtttaattattctattacttgtgtttctagtatgtccaagacattggagagataccacagatacaattatggtacacttgaaggaacccaaacttcatcagattcacaggttttatttgtatttcttcctcaatattcaagcatgcaaattactcaaaaggttttcttagaaaacatcaaatagttcaattttttaaacctaaattagttagtaaaattaagagttaatggataagagcacatttaaattatcactttttgtgagttatcatataaaccttaactattcattgttttctttatctgtctaaactatcacttaatttgtattaaacacacctcaatgctgagttggtaaaatatttattcttattcgacatatgtgtgtaggccaactcaatattgatgtgtttttaaatataaactaagtgaaagttagaaatatgaaacttgtgaaaatgtaataatttaagcatatataaatagaaaaatagatagctgatatatgaaactcacgaaattacgacaatttatgtatttttcttttaattaactctaccattaaagctaataatattgatggctaattttgatgaaattgattttcttgttgtaaaaaacagaacaactaccaagagtatttgaagcttaaaacaagagtggaaatgttacaacagtctcaaaggtgagaaaaaaaattacttatttagaccaagattattagatgtaattttcaactccgaatgcattaagttgtcgctatttcacatggattggaccacataagatttgttgttgcctagagttactatttcaacgacttgaatgtgtgacctcctgatcacacgataacagatccagactattcattctttataatttattttgaaataactttttcatatttttaggcatttgctaggtgaggatttgggacaattgggcacaaaagacttggaacagcttgaacgtcaattggattcatcattgaggcaaattaggtcaacaaaggtactacttttattttacaaataatgacaaataatttaagataattattttttaaaattacgaagaaataatttgagacagagagagtatctaataaggtcttaattgatgaactactttttttaaaaaacttgttttcagacacaacacattcttgatcaacttgctgaacttcaacaaaaggtacattatatatagaaattaattaagatgacatttagttattttaattttctcaaattatattggaaatataatatgttttttttacttcttgtacaggaacaatctcttactgaaatgaacaaatctttgagaataaaggtaacaataataacttagactatagttttggcttaattttgatttacaaattactttgagatcgatcactcgactttatctactataacagtaaagtcaaattataatttcttgtctcactaaggtaacttcattatcatatatagttgtaaagtcacaaaattatttttgtttacttacgttacaataattgaactgactatattgaattgttatcataaataaagttcagtaatcgatcatatttttttttaacaataacttttctatggaattttgataattttagttggaagaacttggtgttacctttcaaacatcatggcattgtggtgagcaaagtgtacaatatagacatgaacagccttctcatcatgagggattttttcaacatgtaaattgcaataatacattgcctataaggtaatattgaaaatttctagcttttcatgaattttttttttaataaatttatacatataaggcacaatcaatacacaacaacaatattaacgtatcagtgtaacctcacaagtagggcctgaaaagagtggtatatgtatcagcattatctttagttaattcgtgaagatagaaaagttgtttataattgacctcgactctagtaaatcatatcaacataatacacacaaattcaatatctaatcaatcaaacgtgtagtatattatgtacacacatttttaaaaaatatcttattataaacatgcatatattttgaattaagaagcaattattacgtgctctgaaatcacttatgactttattagtctacttgtttgagactgagacacggttatatatatttgttgatttagttacggatacgataatgtacaacccgaaaatgcagcaccatcaacacatgatgctactggagttgtacctggatggatgctttgaatttggagtatatggagagaaaaaatcctcttagttatacaagttatttatttttattaaaaaaataagttagatggagaattatatatatcatactttaaagaacttatattgtttgaatgttttagctagcaaacactttggattatatataatattgtgatatatttattgtcaagaagagtatggcaatattgataacactatatttttgaattactatttactattttcctttttatgtgtgttcaagttgaggccacatgaatccattggagaaaataaaaaaaaactttgaaaaaattggaggttgatatattcatctatttttcacgtttgagtttaattttttttcttctaaaattctattgttttgtttaatacatgcacattcatatatcaaagatattttcatcgaatccgcgattgttcaaaaccttttagaaggtttttatcgtatcgaatttaattatgatatcatactaaattagatattcagattcacccaaatgaaaaaaaaaatacgcaatataaacaaaattttgaagaagtacgtttaacttattctccctccgttcagaaatatttgccgtgttgtgcttatcgaaagtcaatttgattaattttcaaaagtaaattagatcacattaattcgatattttaaacaaaaaaattagatgttctaaaactataagaaaagtactataaattacaacttttttatattaatacgatgaaaaaatacatcttaaaatgtcagtcaaaatttttatagtttgactttaaaaacagaaactatgacaaataatattgaacggagagagtaattttcttaataagatcatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatctgtgatagacattatatatccaccatacaaaaatgagtaccatactatgttgtcctttcaaccaatcaaaactcgacaacacattcttaaataccatctggttttcattttaaataattataa

SEQ ID NO: 514 - DNA, 6096 bp, Solanum lycopersicum; identical to SEQ ID NO: 353

SEQ ID NO: 515 - DNA, 10428 bp, Solanum lycopersicum; identical to SEQ ID NO: 278

SEQ ID NO: 516 - DNA, 17804 bp, Solanum lycopersicum; identical to SEQ ID NO: 354

SEQ ID NO: 517 - DNA, 6764 bp, Solanum lycopersicum
ttaaaatcttatggacaacactttcttatttaatgtatttagtaaaaatataatatttatcagttcaatcgaaaggatcttcatgatctcaaacaaaagaacatacataaataataatatatcatgcactaattttttagttatgatacgtaaatttcaatttatactaaatgtatttgtaatataacaattgccaaataataatgtattgatctcaaacctaaaattttatgggcaacactttcttatttagtgtacctagtagaaatacaacacttatcaatttaaattgaaaagatctgatatattttctcaaaaattttgataatttttaatcaaaattgaaagaatcttcaatgaattaggagaataattttgaaattcaaaattttcgtctatttttaatcaaaatggaaaggatcttcaatgactggagaagttcttgaatcaaaatcgaaaatatatttgatgaacttgaagatttacaaaagaaatcgtttgtccaacaacatttccatacaatccttcataactcatcccccttttcaaaatttcgatatattttttttatgaaacaaatagaatgatgaacaagaagaagaaatttaattttttgattttttttgggttgttacaatatagaattttgaattcttgataataattttgaatggaatatttatttaattttcaattttttcccttaattagtggaacaaatggatactatgagattttaaattgattttttactattttttttctttaataagtacaacagattgatacataatgtatcaataataatgcatccgactcgttaattatgtatctaaattgtttaaaaaatataaaatttatgttattataaaaataataaatttatgtaattataaaaataataggaatagaagatacactatattatttacgtaagttatacaataaatttccgttgcgtggttattgattttaagcaaagcatgattaaatggaaaacaattggtatgaaccatagcactaataagcaagtgggtaaatcatgatttttgtctgacaagtgacagggataactagaggtcgtcgtcggctagtctttgggccatccaacaaaacaaaacttgtatgttagccaatttcgattcattgatttctccgctgctactattttccccaacagaaagaattgcttcaaaattagggtttattgcctgaaaattactagttttacaacgattgctccaataccttctcctaatttccattttagttgctgaaattttgacgcctgatgtaactgtattttaggttttaattgtgaaatacgagtttctcagatcagatcagttcctctggtttttttactttctaataaatggctcttcatgctactgctttctccttcactggagtttctacttcaagtaaatcttccagaagcgctttgctttcagtctttcctcttcctagaagatgcactgtcaaagcaacttcccagtatccgcacagctttcctcgatgtaaaatccaaggtgttcatctttttaaatttagtctactttcagaagactggatttatcatttatatgtgtttgttgaaaattagttaattttgtattttgtactttcttcttcaactatatttttactttaaggaagagcattgccaagtgacaatgggctagtggagaaggatgaatcttctcttgttgtgtgctttggagaaatgctcattgattttgttccgactacaagtgggctttcattggctgaagctcctgcatttaaaaaggctcctggtggtgcaccagctaatgttgctgttggtatttcccgtcttggtggttcatcagctttcattggcaaggtataattttgcaaaactactttttttttaccttctatatgaattcgatgtgctaaacgtaggtttgaatgaatctataacagtagataagttcattgaagttcaacaagtgtttagacagttagtttttcggtcaagtacatgtatgatcttgaagttaggctacttatcttgactattaggaccaattccaggctgtaggaggaggaaactctttgttgttgtttagtttcctctattcaaaacatatgacagtgtctggttacggaaataacattagaagctgcaagacaattcacttagttggaacaatcaatctttaatgcatggttgaaattttgttatatctgaatagaaatctgaaacttgctgtggaaacatcagttgctccaacgtatcccgtgtaccatggtgatccgacatctaatgttatgtgcttgtcaaatacctatttctttggcatactaattacaataatgatatcatatatcttagtctatatcattaatgaagaacagctttgctctcatccttgactcactactctgaactactgcactcaaatcaggaaactcatcttaatatgcagcagggtcatctttgttctgctcaggaggtttttgataatttgattggctgttgaagaatcatattccacaaaatttgattgacttgagattatgtgaatgaaaataatctatcaaaaagagtacgtgaagatgggtcgtcaaaacgaatatgtgaagatgttataaattacaaaagcataggccttttcaaatatttaagcattttatgatatgtacttataatttgtaatccaatcaggttggtgaagacgaatttggttacatgcttgctgagattttgaaggagaacaatgtcaacagtgatggtatgcgatttgatccaggtgctcgcactgctttagcatttgtaacactgagaaaggatggagaacgtgaatttatgttctatcgtaacccaagtgctgatatgttgcttcaagaggatgaacttgatttagagttgatcaggaaggtaatgaggttcttttatccttgagatataagtagtagttcatagtttcattatagcaaaagaataaagagggacgagaagagcaaaatataggatcataatttgaaactgaaattggttatggtttttcatgagatacctccagtcataagaccttctgtgttcatcctctttgttacttctgctaagagtaagttacttatttatatgactattgaatatattaaaaaccttatgcagttcatgatttggttcaagagtaccttccaatccaaatcttcagatttttaaagaccatctgatttgagaatgtatgagcattttgtatgctttctggaaagcatgttattctagtagtccgccaaaccttaacaatacttctatacaatgttgttttccttattgcaacagtttgatcatgatacttaacatttcttctgctgtttttggtgtggactcttactagtaaattatacttagatggtcaatttgatagtgatacccaatgattcctattccgtatgacaggcaaaagtttttcattatggttccataagtctgattacggagccatgcaaatcagcccatattgcagctgcaaaagctgcaaaggatgctggtgtgatcttatcctatgatcccaatttgaggcttccattgtggccatctgcagaaagtgctagagaaggaatccttagcatatggaatactgctgatataattaaggtactttgttgcaaatgtccaatgtaaaattttactacttgttaatggaaatatattttatcttgcaagagagtcggtctggagagtctgaattttcatatgcaatgttacctatgatgtttcagctgcttgttatcaacagataagtgaagaagagatttcgtttttgacacaaggagaagatccttatgatgataatgttgtccgtaagttgtaccatccaaacctcaagttactcctcgtcacagaaggtccagaaggttgccgatattacaccaaggtgagcttctaagatgtggtaaaactcagcgttataaatattattcaactctgctgcatgcctgtttgttcttctagacaaactgtaattgttactgcatcccactctacacaattgatgtgcttaagcaaatgatgtggtaattctttatcatgtagttgagaaatctctgtatttgttcctttatgtcttcagatgtaaaattcatctttcataacttcttagactatttcaacatttattaaatatacaatctgctgttgggttaccaagatttgtgcgcatggatgctttgcctttttaaccagtcgatccctagctgaacaagtatatgattatctatgttagagttgattggcttgttgctttattaatctagaatcaatatagattcatcacagaaggacttaatcaattgctctgttatacctgtaaaaatattactgataataatcccttgctctctcttcatcaaaaaaaagtcccttgctctctgaagtttattttagaagattctttattcggttttcttttgtgatacatgatcaggaaacagaatgactactgtttcttctattttcttgaaaagctaattagaggttgtctgattaggaatactagaatttaagctgatgttgcatacccagatttgccagataccactatatatgaaaggtaaaaagaaaagagttctctgatgttgctttgaatcatgaaaaataggatttcagtggacgagttaagggtataaaggtggacgctgtggacaccacaggtgctggagatgcttttgtagccggaatattgtcacagctagcatctgatgtctctctgcttcaggtattgccttaatgccttttgtattaaagcgaattatgttctgtagttttaatgttccattatcctgcattctgttggctaccactttacatttctcattgtgtagatggtttctcatgtcatgttatctaatgagcaaagaaaaattgacactgtctatagtttgttcactaggtgtgtatcttcagtataagtacattaaaggacctatgtgatttacttgtagtgactatattttactgtgtcattgaaacctcttatagttaataccctagataatgtcactcacatatgcaatccagtgatataaggcagctgaaagatcacaagtttaacaactgtcatctttgatgaagctaagaccactactaagacaatgtcgcatccttgttctcttgctgtagctacttctgaaacaaaaactgaaggtgctgaaccaattaatttgaattctcaatgtaagattgaaaagtctcatatcggtggttaatgatatgagtggtatactgatatggacttaggcaatcctcctctcatgagctagcttttggggttgagttaaagcccaagacccatttccttactctcaaacatcaacctgtctttccatttggtgttgaactttctttatactttaaagtcaaagcacagatcccttaaatgctaattctgaatctgatttctttaggatgagggcaagcttcgagatgcccttagttttgctaatgcctgtggtgcattgaccgtgatggagagaggagcaattccagctttgcctacaaaagaagtagtgttgaacgccttgctcaagtcagttgcataatatccatccgacctattaatcggttgccatttaaatgcacttgcaaaaagatctccatgtgctccttgcatagttcttgtagggtaaaagaatattgtataaccacattagccaataatcgagaataatttctgataaatatgtggtagttcataacccacattattaagcacatgtatttattcaagatcaatgttcaattcttttgggtaatgcattggtttgattcagtcattcactcattctcaatttgaagtgtttatgtctgtcaacggcgttttcccaactgcgcacaattttgaaaggtgtcaaaatgttgtcagtgtttgttttgggagtcaacatttatttccttccacaaagtgtaaacagattggttgttgcaaatattttgttaagaccatgaaacctcaagaagttttttcacaaagcccgagtcctaaggctaaggatggccaaacaaactagtaataatacctctttataaaccaaatggtaactcattttgcggatctaattaagttgccaaaaacaaaaactcagaccaactttgcctacattataaccatcgcaaaagaaaaaggcaaagaagaaatcaaagaatggctgaagatccacaagacgtagccgatcgcgaactagtcttcaagcgttttgatttaaatggtgatgggcaaatttcttcagcagaacttggagaggccttgaagatgctaggctctgtaacctctgaagaagtccagtatatgatggctgaacttgatactgatggggatggcttcatttcttttaaagaattcgaagaatttgctcgagccaatagaggtttgatcaaggatgttgctaaagtattctagctttcttgatgcacaaacttaaccattagaaaccgattttaggtggtttttgcaggttcaaactgaatccattgctttcagctcgaactatgtatacgaatgcaacatatgtttaaaatgtatacatataataaaatcatactcattttgaaatcatcgactctaacatataattttgatatatgtgtcactttcaaacatgtgttggtttttccttctttcttctttttttcgttaaaaaaaaattaattaaaatttagttaaactgcaacgtcttattccttacattattgttgacgtggattgtaggtataatatctcttcttttgg

SEQ ID NO: 518 - DNA, 4806 bp, Solanum lycopersicum; identical to SEQ ID NO: 359

SEQ ID NO: 519 - DNA, 5468 bp, Solanum lycopersicum; identical to SEQ ID NO: 403

SEQ ID NO: 520 - DNA, 5246 bp, Solanum lycopersicum
gttattggaatgaatatcttgaaccttaaggggtctcttgggaaatggaccaagagagaagaaactcataccttaatcgatgttcaaacgctgatgttgctgcccggaaactcctcaaacccacgctcaatttacttcaacatacacctcactcgacgaacctctcttagccttgacattttgattacttttcttttacttagatattcttgagatttcttcaagtgtgattaactcttgatgttattttcagttcttgaaattatttttggaagaaatcaacgtgagagagatatgtagaacatgagagatagagatagagtgttattaggattaggagactaaattcaagacttagtcaaataagatttaaattagattaatacaaaaatttgatttattttaattaatacgtaaaaggaccattatgcccttaaaatttcagatttttaattaataattaaatcatcttaagtacttattatttaatttatttatcttttcgagtcattataaccctttgaaacagtcacaatctttttgaaagtcataacctttcatgaaaattacaactttttataaaagtcgcagtttttcataaatgtcacaattattcatgaaagtcccaatttttttatgaaagtcacaattttttttttataaaattcacaattttttatttttcattcacaccttttaaaatctaacataattaaataccatagctacatttagtagaatagatagatagattttgtagtttcattagatattttgggtcaatgataaattgataagccttgagaaatcgatatatcaggaccaaatcaatttacacctttaattaatattacatttcgatcattttcttagtttgcgacttattttgccgttgtccgaaaaacatatgataagccacaaaaactattttttatcactgtttttcaataaatctttgttaagtactttattatatacatatgtgaagacgaaattgaacaatgtgtagattctagaatgcaagctttggtgtgtgctaaaatgagcagaccttttgctactgctcccttggtggttccggtcgcccactctcttcttcctcgtcatctccgcctctcaaatctgccgcttccatctctcactgcaacaaccgacactgatatatttcgccgacgtttcttctcgccgtacaatttccgatctgttcccggtccggtgatggccggtttaggtggttttgatgttattggtgatggtggttcaatggttcaggatgctggtgcgacggctttggttatcgccggcgcttatgcttttgtctccacttttgatctcttatccgagcggaagctaattgaacaggtcttctatctctctcatactcacaaaacacagttagtattatactgtatcggaatctgatttgattttacttagcagaagtatgcgtgataagaatcttttattccattaaaatcagcactagcttagaagtttctactgctcatgaaaaccttgtgaattttggaattaccaagtatttccatggatttcccttaattgggtttggtctttgatttttgttcgttttgctcatttagtgaaaatctgtgacccaaaactcattatgtatgaccctatttggcaaagatataagtttagaggacttgtcccacataaattatgtaggaaaaagttagtgttgttgggtttggaaaagtgtgaatcgtaaattaaagtctttttttctctagaagatgtcaagagaaaaactgcaatttgaataaccttttttcacattgaatggattgtgacttttacaataattgatgacttttctgataagttgtgactttatgattaagatacgtatttttggagaggaaattagaatttagcaacaaaaagttagtgctgagttttctactgcctaattcttcaaaattgggctcattttaattgtattgatatttgacttgatctatcaagaaatgtacactatttgaaccttattgtgcattgaaatgtgtatattacttatcacgtccttaattacttgtccactttttatttcttagttgttcttaattacatgtccattttgacaaataaaagaaggacaattttttttacttattatatcctcaattaattactttaaaaaatgtataacttcttgaaaatccgaagtttttaattcatgcacttcataatgaataagggtgaaatagtaaactcattatgtcaatcattgttatcttaataggtgtgtcaattcaaaagtcgacaaataattagagacagacggactattaatacatgaaatcgattgtattataatgcaagagctttgatgcatgcattagctacccctcgtcaaaatctttttttctttttttaaaaaatcttttatgctatatttgtagagggtatctttgtaaataaatatttttcaaaaaattatgcaatgtatattatatttaatacaccaaaccaaaaaaatgcataaaaattaataatttatgcaagcataacaaatacactttatttcttatacaccctaccaatcgtacactaaaaaaaattattctggtcttaagcttcactttcttatttttagcaattcatattcctttttattttatttgatacaactttgcctcagtcctacattagttaatatagaatcctctatccgttcaactccgtttgatccttccattccattattatttgcttatataatgatttgactaggaaactttcaacaacttgtgggttgacggttgagaaccatgagggtttaggttcaaatctctaggtagatagagttacctttgtacctgttattggaggaaggcaggtatcccgtggaatgctggtatggtcaccacattatcaaaaaataataatagagaaagcgacctatcaaaaataaaatagagaaacgggcgagacattttaggcatgaagcaaaagctcacagaaatttgaacattctatgaatacttaagatactttcttttgggagagaagagggagaaaggaaaaagataaagggattaggtcttgtgtgatgtctgcactaaaggtatttataagacattataatgatcacttgattttcattgtttctcgtgatatttatttcccccttcatttgttgaaacagaacttaagcagaaagctggtccacatattgtctggtctgctttttatggcttcctggccgattttcaggtattgttatgtcattatgatgaatgcagatccatctttgaatgttcttactgatgatttaggtcttagattagcgtatcaggacgggctcgctactttgctgctgtagttccacttacaaactgcttgagacttgtgattcatggcctatctttggctactgatgaggggcttgttaaatctgttactagggaaggaaagccagagtaagttcccttccccgcctcgttcaacagattcatggcattgattcctctcttacgtttcagccatttccttgcagagaattgctcagagggcctctatattatgttttagtgttaattttgagtgcggttctcttttggcgtgagtcaccagttggagtaatttcattagcaatgatgtgtggtggtgatggtaagagctgaagctcatatcacgtagtttattgtgagaacttcttacactttttgtttttaaagtttgttctatgtaggaatcgctgatattgttggaagaaggtttgggtccacaaaattaccttataataaacagaaaagcttggttggtagcctctccatgtttgttgtcggtttcctggtatccattgggtaggtttggtccttgtgctgtttgtttgtgtttagatatttaatttgttgtaatatttatgctgatgctagacttctttcatatggttaaaggatgctgtattacttctcagcgttgggatattttcagttggattgggtttcaactgtagaaagagtagctttggtgtcatttgtagcaactatggtggagtctctccctattactggaatggtagacgataacatttctgttcctttggtaagcatggttgtagcatcattggcttttgcttattagaatgttcttatctttgcgtgactgtgctgtcatacattaggtgatgattcctgtttcatcttcttgtggtgctcttatgtatatgaattagtgaagataagacaggttctttttaggtattcacaagtcacaactcattgtgtctctatggttatttaatggatcaaccaagcaccactttatcatctttaaatggttggcatataagttgttattttgtaggcaattgttcatatttcttttaaggaaacacattggtaatgaagatgtttacgctaggccttttcagctgtcaagacaactctatcacaaagaaatatgcaatgcaattcgttatgtcgaagccatgaccttccctattcaatctcctgagaatttccaactaggcttggttttgctatgtcgtactgagggatgtacgtccaacttttaatttacctattggtgatgaaacagctctaccaacttcctaaatccaaagtgctccaccgctaaagcaactatttaactctttttacccaaactcacaaagttgttcagcctatttaattgtttttcattaatatttgcaactaaaattttaaggtttaaaccatgttgataacccgtcctacctgacctaatccgctaaaaacattatattagccttctatattacttttgttctccattttttctcctcagtttttttttaaaaaaaattattcagatacggggtaaagtacaaatgataaaatctcaaccaagatgatgaaatctcaactggcccaaattatgcaactatacttcttgaagccttttcttttctccctggcagcttacgaagacagattgcaatttgccaaatcaccaactgcagcatgcatttggaaaatctcgataggagtaacatttctgactttcgcagtcatccaatattctaagtaatatgtcaccataaaattgactttctcaatcttcaaaaccttgtacttgaaaacattgtgcactctctcgttatattcctgaatggttccatcattaactcacgcatcttcattggagtcatatactaataatattccagcagccaaagacgaacccggatggatatcaatgtcaaaacaatgagtttgacgaaattgattgatgta

SEQ ID NO: 521 - DNA, 5008 bp, Solanum lycopersicum; identical to SEQ ID NO: 365

SEQ ID NO: 522 - DNA, 8200 bp, Solanum lycopersicum
agtaggttcgagcaattgacatgtagcttggagtccattatatgagaatggttcgtgtggtctgaagtcgcgaactaagtagattggcctaatggtgttgattcatctggaatcgaaccgtgtttcctttacgttgttgtttggatatcaggtcgatgttgtaaagaacatatagtacactaataagttgagtaggaattcccttttcagtttatttcttgccttttttcaccccttcctttttactggttttgcaacatgcagttgtgctcaagtcctcgaaagaggctctgtaaagctaacttgtttagtctgttaacaaaagttgtgtatgcgttcctgcgtgtttctattagatatttttgactgacaagtaaaaatgaaaatctaatttagaaatatgtgataagtaaaagtgatcggaacggaggaagtagctaatttatacgatgaaaatacatacaatcagttttcttgaaaggtcgcgataagctttgagacactgcgcgtaagtttttgaatttacgaagcctagtctcatatatatttaattttataattttatttaagaaaataagcaaaaatagtacttttattattttacaaataaattttaataaattacgtataatatatagaaaagaatatgataattttatttaagaaagatactaataaccaataatgaagaaataaagtactacaattaatatttaagaaaaatcattcaaccaataataaaagatatgtaaaaaaaaagataagttaaaaaatcgattaggacgtacgattttacgcttcgaaatcttaaattgaatctacgtttttcaattgcgtccaaaatatttttaataggctttgtttcgtgactcgtcctttattaggtgttccaatataatttttaagtttatgtgaacatgttgaatttggtatgtgacaaaaaagagcctcgtgtataccaaaatgacataacaaggaaaatgaaaatagccgtcggtgcccttctctttccctttgtgtaaaagtcaagcatatccacctttgaatccgacgccgtttcataatctccgagcttcatcaatctccatttccagatcgaatgtgaaggagatcccaattcattcgcctgaaaaatggatgcggtatcgatcagagtaccgtataagaatctgaagcagcaggaagtggaattaactaatgttgatgaatcacggtttgcacagctcgagatccgtagtgattcatcatctcctagggtttctaatggagaaatgaatgattctaatctacctcttcctccaccgcctgtacgtaacagtttgctcaccttgattcttagttgcaccgtcgctgctggggttcagtttggatgggctctgcaactatctctccttacaccttatattcaggtgcaaacattttggattacttgtcatgtttggtttcttcatagtcaatttgagctacattaattcaaatatttagctgcgatccttctaacaatattaatatgatcttaaaatgtcggtcagcatgcagtatatagtgttaattgaatttaaagatgttaattttactcatttacaagctctgtttttgatttgtttgaccgaatgtggagttacgagattggtgtatgtatgtatttatactagtgataacaacaacagaaacaaacctagtgtagtattgtaagcgagcatctgtggaggaagtagagaggctatttttgaaagacccttggttcgagtaacacacatttgaagcagctaaaaaggaaaatgaagaagtaaagaggacatagcaaataagaggggaaacataacgtagcatccagaataggagcaataaggataactaaatgatgtgataacagaagcacactaataacgaggagtataaaaaaaacatagttggaagcaaggtagcgctccaagacacaaggagtgtagtcttatcacggcactgccaagttcctcccttaaatcttgactccagccgaggttacgtaagtggataaaaatttacagctgcagcaatgagaatctagtttgaaaattccgacacaattttcaggatgatttagttgatgtctttgatgattgtatacaaaacaacaagaacatacacagtggaatcccacaagtgggatctaggaagggtagagtgtacgcgggccttactactatctcgtggacgtagataaaccctcggctcgtctttaatgttttgtctagaagtagaaaaaaatatcctgtaaattgaacatttagtgccatgtggttcacatgaactctctactgtatttcatttgcaattttgttttggtggttgagaatgcagaaactgtctctgtgatcagttcacttatatttcatagagaaaaagagatcagaaattgattaaaggttcttgtatatatgaaatattattgatatgtattagagaaggaagaggaaataagcataaaagaataaattatattgtgacctatagacgagcactttcggtttcctggtgaacatgatatttaaggatctttagagttgaagacctctgaaaaaaattcattttctagaagcttcgagctcctcaagttgaaaagctatttcgcaagagaaccctttgcacatcttagtattatacaaattggaagctatttagaatagttgagtggtcccagttgtttcgtgatcaccgagaaagtctcttggctagtggtacatggtttgaaacaaatggataagttgtttctgctatcctcaagcaataagttcttataattttctatcttttagtggcttcagtttccttttattattttgtttgcctatttctagttgagcttcttctttgcctaaaatttttcatatctatgttttgcagacacttggcatagagcatgccttctcttcttttatttggctatgcggtcctattactggccttgtggtaagttgttcaaatatcatggagttttattgcagattacttggtaaaatgtccatctgaagtgatgaatatcagtaattagaatatagaggtgtgaaaacagctctgctgagataaattgctgaaaaaataagatggtgataacctttgcacctgcaaaaccaattgcaaaagctacactgtttgagatttgtggactctttaaacaagaatttgttagacttcagcccatgtacttaaaattgtagatatggctttgctgaactgtaacttctttttttaactttggatctctgcaaaatttgtcagctgttccttgaattaaaactttctatcctttgatcagtaaaacgaagtcgccagatatatggtacatacaaataaaacttatatattggagaagtttctccagaagctccgttgcttattcaacttagaaacttgtcttcttggatattctttaggtacaaccttgtgtaggtatatggagtgataaatgtcattctaaatatggcagaagaaggcctttcatttttattggagctgtcatgatctctattgctgtaagcatttagtagttatttttatcctatattgaattatttggttccagttaaatcggctgaactaaatcttgtcgtttaggtgataattatcgggttttctgcagacataggatacttattgggggacacaaaagagcattgcaggtttaaacttcctcttgttcctgtaatttttttggattatctgaataggctgtgaagtcttaaattattgtgtgaaaatgcagcactttcaaaggcactcgctcaagagcagccattgtatttgtcgttgggttttggatgctcgatcttgctaataatactgtgcaggttagcttctgaaagcttactgctatttcaagtggtgtagatgattctagtagatgttacaccatagttgttttatgttggcagggtccggctcgagctcttttggcagatttgtcaggtaaaaattccgatagatggaagaattattttttttaaaaattaattggtacagttcttcttttgttgcaatttgttgagatgtattgggaactttgttgtaggtcctgatcaaagaaataccgcaaatgctgtgttctgctcctggatggctgttggaaacattcttggattttctgctggagccagtggaggttggcacaggtttgctgtttattgcgtatctgaagtgatatgatgatgttatatgtgtgtgtgcttatgtaaaaagatagctcacaatccccatcctgcttgaacaatatcacttgttcagcattcttcttaagggccatgcctttaaaagttgttgagcttttggtagcaaaatgtcttctgaattaagacttggttaaaatatcacatgcgtaaggtagtctttgacaaaactttgtatctggacagatggtttccgtttttgacaaatagagcttgttgtgagccatgtggaaatctcaaagcagcattcttagttgcagtggtgagttaactgcccttgatagagtttttgtgtagatatagtaaattctgtttttgaatcttgatttttgaggtcatctattttacttagacacgttttttctaccttgtttatgtacatagacaaaactagttgctaacaaaacataaaaggaagtttctggatctacttgtcatatcctgcatccttgataaagatatccctcgagcatcttttgtaaataatgtcttaaaacattaatcacgtcctcttatgcatcttgtcacttgctacttgctgatatacctttttttaagccaactgatttactatctttgaaaattggcttctgaaattagatagagtacaaagacgacatttacatttaatcccaagaggggttggctagtgacgacaagaaagtcccacaagattcaagcacattgatggaaaaccagcaacccttaagtacaacccatgaaaatgacggacataaacataaagggtcaacacaaaacaagcagtagattagcttaaattcttgctaacactgtcgattaacccaaaccaagctagatttagaataagaaagaaatgacaggttcaaatagaagcaattagtccacacaagtattatcttcttacccctacctactcctttgtgtgatagaggttttttctgtactctcggctaaagaagtacctcattgactctccaaaaggtacatgtgtcaaacaaagtggaacagggggtgggtttttgactatgaagaactagttctatacttaagcttgaacatagtacaaattaattcttctctggcggttactgtgtgttttagcacccatcatgattctgtcattcaaagtgctctatggactgtgaacaggtctttctaactctctgcacgttagtaactctctacttcgctaatgaagtcccgctgtcacccaagcaatataagcgcatgtcagattctgctcctctcttggatagtcctcagaatactggatttgacctttctcaatcgaaaagggagttgcagtatgcaaatagtgtggcaaataatgaatctgagatgggtcatgtagcagataatagtccaaagaatgaagaacagagaccagacaaggatcaaggtgatagcttcgctgatagccctggagcagttttggtcaatctgttgaccagcttacgtcatttgcctcccgcaatgcattcggttctcattgtcatggctctgacttgggtaagtaacttctgatttttctgatttaagcttttaaactagctgtacacattttcaatttgctgtattttgtgaattttattctttaggtttcttgtaatctttccagtgcagctaattatctatctttctgtcctttcaaccagttgtcctggtttccctttttcctttttgacacggattggatggggagagaagtctatcacggggatccgaaaggagaagcagatgaagtaaatgcatataaccaaggtgtcagagaaggtgcatttggtttgctattgaattctgtaagaactcagaattgagaataactagttatcctttatttagatccaataataggtgatttgcagcttactagaattaattatccattgagagcttatttatgtctctctcatgggtgccccactggcgtctacgttattgtgatgaatctccctgtgagcaggttgttcttggcgttagctcctttcttattgagccaatgtgcaaatggattggttctagacttgtttgggctgtgagcaacttcattgtatttgtctgcatggcctgcaccgctatcattagcgtggtttctatcagtgcaaatacgcagggagtccaacatgtaattggtgctactcgatcaactcaaattgctgctttggttgttttctctcttcttggcattcctcttgctgtaagttttttctattactccatatatttttgtacctgttagctgcttatccaatagatgtgtttttttttgtacctgttcatcttttcatgcattttgctttacatgcctgcaggtaacctacagcgtccctttctctatcacagcagagttgacagctgacgctggtggtggccaaggtattttcttcgatccattaaaatgttatcacgtcttactcgatgaggcgatcattgaaactgtggtatgcttttgcagggttggcaataggagtcctgaatcttgcaattgttgtacctcaggtaactttgcctttatatgtttgatattgaatttcattgaaatgcttaacacatatgaataacaacgacaacatatatacctagtgtatgtaatccccacgagtgacgatgacatagttttttattttttatttacttagatggttgtatcgcttggtgcgggtccttgggatgctttatttggtggaggaaacataccggcatttgccttagcatctttagctgcacttgctgctggaatttttgctatgctcagactaccaaatttatcaagtaatttcaaatcaactggcttccattttggttgagttaatttattgtgttatacttcttatacacattacacatgtagttcatgttactgaagtaacaaaaatatagtacagttttagctgtgataggtatctgatatttttcactcacattcaattcattttaccccaatttttgactctcttgtataatgtaaaattgtcatctgtaatgaggaaaaatgttgtttactctttgtgaataactggatatctcaataatttttcgcaaaatcagttttttgtattattggctcgactaatttaaattcgggtatgatggggcggaccaagagtggttcctgcaactctacagtaattccatagctttaaaaattaagtttatagaatttaaatcctgaattagcccttaaaaaaggaataatctaccgatattaaagaacttctgcacaggacatgaaataagatcaataaaataaggagtattactctctataggtatttaatttatttgtcatgttttgatttaacataaagtttaaaaaagtgaaaaagacttgaacttgaatttcatgatcgtaaacatattattgttaaaaaaaaatagagacattcttttttaaactaatgaaaaaaaggtaataaaatttacaactttagtatgaaagtagtagagggtagaaaatatcaaatcaagattcacagaccttacagtgtattatatatataataattagattattttttggcatatttgttagttatttcttttgaatatatgaacactagattcgtttacctaatacttcctccgttcagaaatatttgtcatgtcgtgtttatcaaaaatcaatttgattaattttcaaagataaattagatattctaaaactaaacaaaaagtactataaattacaattttttcatattaatatgatgaaaagatgcatcttaaaatgttagtcgaaattattatagtttgattctaaaaatagaaatcatgacaaataataccggacagatggagtaataacaagcaagcatgtgacaaatctacatggaaattggaaaaccctaatagattacttcttctatttcttttttgaagtttaagctttaaattctgtgcactgatgaaggcgcgaaaattatttgtataattaggtcacttattaataattatcaataaatttcacaatattcatcttatctcaatttatacgaagaaaatcgaagtacgat

SEQ ID NO: 523 - DNA, 11840 bp, Solanum lycopersicum; identical to SEQ ID NO: 368
  modified_base (3182)..(3617): a, c, t, g, unknown or other

SEQ ID NO: 524 - DNA, 10078 bp, Solanum lycopersicum; identical to SEQ ID NO: 374

SEQ ID NO: 525 - DNA, 9037 bp, Solanum lycopersicum
tacttgtccttaattatagtaattattttcttttttttcttagagaaacaacaattacaattatattattatttttttaaaactatatatataacttttcctttctttattgagaaaaaggtattttcatttttgcttacaaagataaccaaagtatgttattcccacccaaaaaagtgcaatcccttatcataagtgaagtattttcctattcatagataaagtaatttaaactttattaattctaaatattaagatatataataatatatgtattggtaattctattttgaattcaatttaggaaagaatgatatatatatctacttttgagacattagtgtccctgtcgtcaaagaattaaagcatatatatcctatatactaacggatatacatgtgtcataattttatctatctatccgacatttataccatttatactaacaaacatacacatgtcatattcttatctaccgatccgacatttatcgacggataagattatgccacgtgtccctatttagtacttcgttagagtgaagggaatatatgctctatttttggacggcaggagcgtcaggatcacaaaagtacgacgaaggatatctgcataccatttacgatagttcgatgtatatttatcccttttccttttaatttatatatagaattttaaaatataatgaatttataattaaaatcagtctaagtattactatgtacatatataacaatcacattatttcacttccaaaattaactcaaacaagaaattaaaacattaaatgcaaattaatatataaattggataatctaaagtgctgggtcaaattttgggccccatttaagggattgggcaattttttctcttactttttttttgtttttgtttatatatataaaataaaataaaaatagcagttgcaaccaaaaacacacaaaaaaacacacacagtgattttttttgtataaatatgtttacacatttcatttttctcaaaagaatcaatagagaagagacaagaaaaaaagtttcaattttttttctaaaataaaaaaaaattcattttttttgaatgtggaaaaaatgctaaggactaatgtgttgttgttattagttatttgtttattggattttttttcttcagtgaaagctagtgtttcttatgatgacagagctataatcataaatgggaaaagaaaaattcttatttctggttcaattcattatccaagaagcactccacaggtaaattatatacaaaaaaaattgtattatttcattattttcttgtttttggttgtaaagatcatttctttacactttgttatggattgtgtgaaatgggtgtgctttgtatttctgtaattcttgtttttttaagaattttggttgtaaaaatgtgaactttatgcttttttatggcttctgtcaaaagggtctgttttgtttttctgtaattttttaagtttcttctttatacattttaatggattcttagaaatgggtgtatcatgtttttgtgtaattcttgtttttttttaaaagcattttggttctaaaaatgcaaactttatgcttttttttatagcttctgtaaaaagggtgtgttttgtttttctgtaattttttaagtttctaaaaatcttttctttatacatttttatggattctgtgaaatgggtttatcttgtttttctgtaatacttgtttagttatgatttttagttctaaaagtatgaactttacacttgtttttctgtttatttaatgtttttggttctaaaaatcttttctttacccctttcttataaacctatgcgattatgctgagtatgttattattgttgttttgcgttacttaagtcaaaggtatgtaggaaacaaaaggtaaaaagaccctgcttatggaattgtactggatatgtcgttgttattattattgttgtttgtgttagttgagtcgagggtctatcgaagttatcctctctatcttcacttatgtacacgccacacttcctaaactccgcttatgaaattacactgtgtatatttttgttgttattatttgtattgttatttaatttttgattgtaaaaatctcaaactttacatttttatgctctactttttttgaaactctaatatattgtcatttttttttctattggtgattttagatgtggcctgatcttatacaaaaggctaaagatggaggcttagatgttattgaaacttatgttttctggaatggacatgagccttctcctggaaaagtaatgtcttttttttcttaattttttttcttgaatttatatcatgattctgcaatttaatatccaaaatgaattaaaaaaaatttcatatttttttttttgaattttcagtataattttgaaggaagatatgatcttgttagattcatcaaaatggtacaaagagcaggactttatgtcaatttacgtattggcccttacgtctgtgctgaatggaactttgggtatgtttactaaagatacacggagttcaagaaaatgacttttttttttgaattttattattttaaactaaaaatatgcaaaatatattaaaatgctgtttaatcttgttatgtcaaacatgaaaaaagttgattcttttttaaacgaaaagtaagacgaataaattaaaacgaaaggagtaaaaggattggctttagtgtcttttttttttgtagcttcccctgttttatactctgtttttatgttatttgtatgcaggggattccctgtttggctaaaatatgtgcctggtatggaatttagaacaaacaatcagccttttaaggtttttttttttccaactttccattcgtcttaaagtttgagttgttagaaagagcacaacgtctctctttgcatgcatgttaattcttttttatgagctatatcatattgaaatatgtcagaaagtacacttatttgttatagtatatcatgtaacaacgactcttcacgtgtggggttaattcttatttctgactacttgtttgttatgatatcatattcaaatgtacgacaacctcatctaaagtgactatatgttttaagttaatgtacttaattatatcatgtcacaacgactcttcacgtgtggggttaattctttttatagccgaaacatgtggacatgttttatgtattttgagtggcggggtcagagttttacctagtatctctgttgaaatgtgtgactatctcgtttattgaattattagagaaaattacataattttttttattaatattgagtctgaactgtcatgtttctggttgactataataaaaggtggctatgcaaggatttgttcagaaaatagtcaacatgatgaagtcagaaaatttgtttgaatctcaaggaggaccaataattatggcccaggtttgcattatgatcatgccttgtctttacactatttatagaaatgaatttggaattttttgtctcagttttcccccctaattcttgattaagggagtcgagcgttgtttagttttttttgtttcgtttatcatacttatttgtggttgctactgttcttttctcttccttgaaatgttgtttagttccctaattcgtgattaaggtagtcggatgttgtttagttttcctgtagtattattagtaattcccctactatttgtggttgctactgctcttttttctcctcttaattaattgttgttttgttcactgattcttgattaaggtagtcgaacgttgtttagtttttcccttaatccttatcagtagtattataagccattctcctactatcgtactcttcgttgtgtctttgctttgtttatcaaactatttgtggttgctactgtttttttctccatcattttctacaagtttcatttgagccaggggtcaatcggaaacaacctctctaccttcacaaggtcgggatacgactacgtacaccctacttgtggagttaaactggctatgatgttgatgttgttgttgttgcagatagaaaatgagtatggaccagtagaatgggaaattggtgctcctggtaaagcttatacaaaatgggcagctcaaatggctgtaggtttgaaaactggtgtcccatggatcatgtgtaagcaagaggatgctcctgatcctgtggtaagcaatttgatataggacttgtttcaaggttcattttagacatctcatattgtcttgattgtgctacagattgatacttgtaatggcttctactgcgaagggttccgtcctaataagccttacaaacctaaaatgtggacagaagtatggactggctggtaagtatcaagaacgcgaattacatgattctaatgcagtttatgttcttctgagttggtttcttcattcaactactctatttagtcgaatgttcgttaatgatatactctctactatgctcaggtatacgaaattcggtggtccaattcctcaaagaccagccgaagacattgcattttcagttgccaggtttgttcagaacaatggttcattcttcaattactacatggtaagttagaacatctggttccgtgttcaagtttttctcgttaaacatggctattgtattgatgtactgtggttgcttcagtatcatggaggaacaaattttggccggacatcatcagggcttttcattgcaactagctacgattatgatgctcctctcgatgaatatggtacgaaacaagaactagtattcttcttgtatctccacatctgcataacacagaacggaaataatggaaaatttcctaaaaattattcatgcttgtcttgatgatttgcgttatggtgtaaaagggttgctgaatgaaccaaagtatgggcacttgagagacttacataaagctatcaagctatctgaaccggctttagtttcatcatatgctgcggtgactagtcttggaagtaatcaagaggttagtctgttttttttccctttgagtcgagggtctattggaagcagcctctctatctttaaggtaggggaaaggtttatgtatactctatcctctccagatcccactatgtgagactacactcgatatgttgttgtaattgtcgtgatttttcttctaacgctgtttacattttttttgaccaatataggctcatgtttatagatcaaaatctggagcttgtgctgcttttttatccaactatgactctagatattcagtaaaagtcacctttcagaataggccatacaatctgcctccatggtccatcagcattcttcccgactgcaaaactgccgtttacaacactgcacaggtatagtttaaataaataaataccgtcagtcctctctataaccgtcattctctatagcaacatttctctgtcatagtctatgtcatttgtggaaccgatctttcatgttaatgctatattatatgttttctataacaacactttgctatagcagcccaaaagtactgaaacaaatgatgttgtaatgaggcagttatagagaggtttgactgtataagcatttgggccagaagttttaatgtctgcttgtgtaatgctgcaggttaactctcaaagctcgagcataaagatgacgcctgcaggtggtggattgtcttggcagtcatacaatgaagaaacgcctactgctgatgacagcgatacacttacagctaacggactatgggaacagaaaaacgtcacaagagattcatcagactatctgtggtacatgacaaagtgagtaacttacattttcctacttttttcgaatgattatatttagttccgtcttcactcacacatatctatatctaatatcataatgactttttttgttactttttccagtgtaaatatagcatctaatgaaggatttctaaagaacggaaaggatccttatctcactgttatgtccgctggtcatgtcttgcatgttttcgtcaatggaaaactatcaggtagcggaaacaacactattttgggattatggcaaatgcttttccctaacagactacttctctcagttccaatttgtctgacttgacacgaaatttaagaaagtaaagtttgaatcttgtggccttaaacatgtcacgtggagtagagaacaaagagttgccctaaaaaaagaaaagagacattctttttgaaacggactagaaagggatagtaaaacaaacaaattgaaacggacagagtacatcttttgacgtctattcctgttttcctaacatctctttgtccttgaattgttgtaggaactgtttatggtacattggataatccaaaacttacatacagtggcaacgtgaagttaagagctggtattaacaagatttctctgctcagtgtttccgttggtctcccggttagttttctatttcctgtttctccgatcctttattagcaccgataaccaaacctttaaaaaaaaatataacctatggttttaactacatttcagaacgttggcgtgcattatgatacatggaatgcaggagttctaggtccagtcacgttgagcggtctcaatgaagggtcaagaaacttggcgaaacagaaatggtcttacaaggtatgttaactaactaattgcttctcttctccccctaaagcctgatcttcgtataactttgatatgcttttccttgagccgagggtctaccggaaacaacctctctacctcccaagaccttacctgtgggattacactgcatatgttgttgttgatacctgaatagtctatactttgcttgttcataggttggtctgaaaggcgaatcgttaagtcttcactccttaagtgggagttcttctgttgaatgggttcgaggttcactagtggctcaaaagcagcccctgacttggtacaaggtaaattcctactggtataacatcaacaaactacatatcaacacgtgtttatcgattatatgaagttgaatagcgtgtaacacatagttaacagactaacatacgttttccaggctacatttaacgcgcctggaggaaatgatccactagctttagacatggcaagtatgggaaaaggtcagatatggataaatggtgaaggcgtaggtcgccattggcctggatacatagcacaaggcgactgcagcaaatgcagttatgctggaacgttcaacgagaagaagtgccagactaactgcggacaaccttctcagagatggtaagcacatttccaacaacctttaacggagttataggatcacatgaggtagaactacagtctgtatgcactctaccttccctagacctcattctgcgggaatacactgagtatgttgttgttgttccataggatcacacagacgaacaaaacgcaacatgtttgaagaaatgtgatacttttttttaccttcaacttgcattaagatacttcgcgaacttgtaaatttcaggtaccatgttccacgatcgtggctgaaaccaagtggaaacttgttagtagtattcgaagaatggggaggtaatccaacaggaatttctctagtcaggagatcaagataaagaactcgaaaaggtatgcttttcgcctttgagaacactgattctgattcaaaattatgtatatcacgtcgcgtctaaatcataaatttctgttaccattgtcttctactgtgacagtaaaacttgttcagtaactatggtgcttgaattcgcgccgaaaaatacatacacgaagctaacaatggaggctacagtttgcaaattgcagctgaataaaacattagaagataaagaaatatttgattaaaaggagtatataaatttacagagaattttctttattctttgtaaaactttggtttataaagtttatacagaattttctgttatttggattatgagattgaagaagattgtacagcttccaaatactattagaatacaaataaatttcatgtaactatatacaattattacaatttgtttacgtgaaatattaatacaagttatatcaagaaagtcaatttttttcattaaccagatgtttcaggttcgagttttgagtttagattcgcttttagttgaagtattttaaccctcaaagtgagattttccatcgcgaatccagttacactagttagggctccaaagcaggtatcgaaaagaggattgagaaccaaaaataaaaaaatataatctaaactataacattttatttttttgttagagccttgtataatttggtttacattaatgttttgaattctattatagatttgtttcatttgaagttgaaagctaatatagcaattacaactccatcaaaatcattttatataacaaattattcgtggaattaattgaggtgtgcataaattgattgacatcatggttataaaagaaaaataaaagtaacgactaattaataatagctttgatcgaaaatacgtagaatgataaacgagatttaatcacgttaccccaagccaatagaagcataaaacatatttgtacatcaactttttaacacttaccatgattaattagtgtgcatgaattctcacctgattaaatcatttaattttagtaaatttaaatgcttcaagttaaaataattgccaaatgaggaaaaaatgaaagagaggtgtgtgattataattattattataaatatcaattattcttattgaaaaaagtcaatttattttgcaaattcaaatgttttgcttttaggattttaaatgcaattttgaaattgaggtataattattgttattattaatgaataatggaccaaaagtattatgtatttgacttttgaaaaatacattctatcattaaattgatacgaaaacaaaaaataattacttagtaattagttatattagtatcttgaccaaaacaaataaataaatgaaattgtattactatgaagataaagaaacttatcattttcttaccaaagatgtaaaataaattattacttaattatttaaacaagattttatttttactctggaggtatttcaattattat

SEQ ID NO: 526 - DNA, 7510 bp, Solanum lycopersicum; identical to SEQ ID NO: 435

SEQ ID NO: 527 - DNA, 3893 bp, Solanum lycopersicum
tatttattgatttttttaaaaaaataaaaataaaataataaatttatttaaaatgttaatgcactaaaaataaaaaaatagtaacatataaataggaataggaaattttctaattccctcattacgtaaaagtatttattttacccacgtcatttaagaccacctagaggtacttgtctatacttgggtgtatatatatatatatatatattcttccatcttaaaatatttttatatttttattctccaaaacaaaatataactaatattttgttatggggaagtaatactttaaaggtacaaccttttgaaatcggttaaatcacatccagtaggtagaattttttataatttgacactgaatagaccttaacattaaatagtttaagagtatatatacaatattaaaatggtaggaataaattcctgtaattattgttgattaatggcatgaggttaaaacaaagcacgccgcttaaacaagttttttgtttaccaattatcattatggtcgccgtaatcacatgcagtgttttttttaattagtctttgcataattccctctttttcaacgggtgggaagccaaataacatagaatactccatcacattattacataatgtattaccattagctgaatagatattaaattttggtgggagatttgaatggtataattttgattggagtattttttttttataaaaaaaataataatatatttttccattttaaattagttgttagatttcattagatttaaattattgaatattaagttgatctaatacattttaacattctctaagaaaacgaaatataagtatggatgagatatattattaatatagaaactagaaactaacctaactatcaaaactacccagtgggaatccaaatgagaaattatgaatcaattgaggcccacttatagtttaatcacgccattcatcccggatactttcttcctttataaacccctctcccatttcttcattatttactcaactcaacacaatatattcttttctacccccacaccattaaaaatatgtctactcttttcttcacattttccctccttcttctagcaccactactcgtaattagttcaatccaagatccagaacttgttgtacaagacgttcataggtaacacaaaaaccactgccgacttctatttttattcaatttattagtatttactaattttattttggttattttgaacaggagcatcaatgcgtcattgacgaggaggaatttgggctatttatcgtgcggatcagggaatccaatcgatgattgctggcgatgcaaccccaattgggaaaaaaatcgccagcgtttagctgattgcgccattgggtttggaaagaatgctatcggaggaaaaaatggccgaatttacgtggttactgattcagggaacgatgaccccgtgaaccctaaacccggaaccctgagacatgctgttatacaagacgagcctttatggattattttcaaaagagatatggtcattcagctcaaacaagagcttgtcatgaactcttataagaccatagatggtcgtggtgcgagtgttcacatttcaggtcaaaagcagatccagacttgatatttcattattttctaaaaatttattatatagtcgattaacattgtttcaggtggtccgtgcattacaatccaccataccagcaacattataatacacgggattaatatacacgattgtaaacagagtggtaacggcaacattagggactcaccaaaccattccggatggtgggatgtttctgatggtgatggtatttcaatttttggagggaaaaacatttgggtggaccattgttcgttgtctaattgccacgacggtttaattgatgcaattcacggatctacagcaatcacgatatctaacaactatttcactcatcatgacaaggtgatgttgttgggacatagtgattcttttacacaggacaaaggcatgcaagtcacagttgcttttaatcattttggtgaagggttggtgcaaagaatgccaaggtgcagacatggttacttccatgtggttaataatgactatactcactgggaaatgtatgccattggtggtagtgctgcacctactattaatagccaaggaaacagatttcttgctcccaatgaaaaataccgcaaagaggtatttcaattcatcagtgaacatgaaatgatatactagttacagagaaattattttcctttgaccatcatatttaaacaaaaaaagtttagttgaaaaataatacctaccttgcaaataaattataaagttggtattgaattctcttcatataaaacaggaaattctagttaaagggtttgaaaattgctacttttgaatccacttgtacaaatttttggctcggcgctgacatatattatttcccaatatcctaatttttttaggcttgaacgtcgttatcttttagaatttgaaatgtggtaagattatgctaaatatttgaaaatttaacaggtgacaaagcatgaggatgcaccagaaagtcagtggagaagctggaactggagatcagaaggtgatttgatgttaaatggagcgtatttcaggcaaacaggggcaggtgcatcatcatcatctacttatgccagagcttcaagcttaagcgctaggccttcttctttagttggatcaattaccacaaatgccggtcctgttaactgcaaaaaaggctctcgctgctagtaaatttaaatccagtggctactaaatttatttcaaaatggagaatgtacgatgactagttgacgatagtgaaagaagtagtgttttaattaagctgaaaatggtgtacggaaaatatatggagaccatttcgcaaaacttatatctcatcgttttctttttctcaatttttccatgaaaaactattactactaattattgtcatttgaacgtttgtttcttaatatagtgactatcttgcgtttttcctaatatgttcctttatttttacttgtccaaactagcaaactttataacttagtttgcaatttatcaatattttattatatttaaatttcaaagcgacgagcaaatggtaaaaattgaacaacttgatgatcactgatggtatcatgatttttaggatgcttaacgactttttatacataatcttccacaaatgcatgatcgatacaaatgctgattccgaattcatatttgatgagtttaacctttttaggactagtcttaatcctattcaacgcattaattatattttatgtacatacataaatttatatatttgaccaaattattaaattcaatttaaatatacgtctcatttgtctatatatcgtaccagaaaaactttcgtcaatctaaaaagttgaaacataaaaaattgtacgacactacaaaaatatactaaacatagcacgcacataagaaaagttatagcaaacttattttgcatatatcacagatataagggatcatttttgttattttctcgttatttgagtatgatccgatatttaatgtgaacatgcatgggatttttacaactgctttagttgggaagaaatagattggtcaatacacttgcctttttttcccactcttcttaggagctttttccgtcaattatggaaatgaccctacgctacaaaataatgaaattaacggcattattcataagtcctttttttttttgacaatttgacacttagcaattaataactattcctctgctggaattgtaggcattaaattagataactaaatgaactactgctccttagtccattattatttcttatgatttctataactttaattaatatttaagatgtatttttttattgtataaataag

SEQ ID NO: 528 - DNA, 3694 bp, Solanum lycopersicum
ttacgtaaagatgaatctaagagcttcttaatagtagtataagacaacattacctttaatattttaatcaaaaaaagaattccttttgctcatgtagcctatcaatggccacatttttatttttctttactaattaataatattttaagaaatggagcatcttttcctttttatggaccatgccaagatgacacttctacaactaatttaagttgtatacctaactcaactacaatatatttgatatataattttataaaataagatatgagatagataaaatgtatgcatacctaatatttcgaagagagttcatacgatattatttgaaataaaacatttaaccagaacaagcgggagatgaagggaaaaagtagcagaaaaataaaaggaacacttattattattaggtgcaacttacttattagttaccccaccaaaagagagacaataagtaggaattgcccatagccatggctacaagacattcttccaaacctggcagggtccatcagtatgtacacacatacatcatccaccactcctgttcccacttctcatttcttttatataatatataaaaatattgcaaacttatcgaattagtttttgcatgcatttcaattatttcgcattattagaattttatcgaatatataacaaaattttaaaaaatatatatataaattgaattaaaaccactctatttaaatggattcattactaacgcattatatctgcttctgacctgtatcaagtaactcgatttatcaataattagacgaactaaaaggaacctatcaacatattttctaatttgttccaagatttgaaactactctccaggcaacttctcacattccctttatttgctttagattttattttttatttgcatgtcaattttttaagttaaaattcaccctatcttttatcaattccatctgttatcctacccctttcaaaggcctataaatacccctctctagcatattactttatcactcacaccatagagaacagataccaaacacaagcaaattaaaagataaactagagagtcagcttagtaagaaaagaaaaaaaaacagaaaaatggagagtaatttcccagttgtggatatggggttgcttcaaactgagaaaaggcctgaagcaatggacaaaatcaaagatgcatgtgaaaactggggtttctttgaggtaaaattatattttacactaatacaggatcttgaagaaataaaaaaattaactttcttgatttctgaacttttttttttttttggttgtctgttatgtgatatatcaaagcttgtgaatcatgggatttctcatgaattgctggacacagtggagaatttaactaagggacattacaaaaagtgcatggaacaaaggtttaaagaaatggtggcaagtaaaggacttgaagctgtccaaactgaaattgatgatcttgattgggagagcactttcttcttgaaacatcttcctgtttccaatgtgtatgaagttcctgacctggatgatgaatacaggtttataaaacaaaaaagatccaatttttatcatttcatataaacatatcctatactagatggctccaaatatctgggatttgtatcagttcagcttgtcacttataaagtgacaaactttactgttgatcagagtctatccttagtcttgagtcttgattagtagttctttttttttttttaacttaacttatattacctataacctcatgacaggaaagttatgaaagattttgcactgaagctagagaaactagctgaaaatcttttggatttgctatgtgagaatcttggactagagaaaggttatttgaaaaaagcattttatggctcaaagggtccaacttttggtaccaaagttagcaactatcctccttgtcccaagccagacttgatcaaaggccttcgcgctcacacggatgctggtggcatcatccttctattccaagatgacaaagtcagtggtctccaattgctaaaagatggcaattggattgatgtacctcctatgaaacactctattgtcatcaacctcggcgatcagctagaggtatgcattccttttaacgtgttgtagcaggtaatcgccttatttttctagggtagtactgattttgtttgaatgattgaaggtgattactaatggaagatacaagagtattgagcacagagtgattgctcaacaagatggcactaggatgtcaatagcttccttttataatccaggaagtgatgctgtcatatttccagcaccagagttgattgagaagacagaagaggacaacaaattgaagtatccaaaatttgtgtttgaagattatatgaagttgtatgcaggtctcaaattccaggctaaggagcctaggtttgaagcaatgaaggctgtggagactactgtcaacttaggtccaatagaaactgtttgataatcttttcaagggggaatttgtttatgttttaataggacactaattaagaggattaaagaagttaaggtttctaaagctgtgttgtccttttagttaataatttactatgttacttgatgtgtcattgtctgttgtttggtagtgagctgtttgaggttgttctctatggggtatattgtaaagtttcctcttttactttaatgaaatctatgcttaaagaaaacaaactctttctatcacttactacatgtttgagtttaattaatatacactgacaagataaaaagaaaaattacgctgaaagagaattatgaataacttttcatgctagacatggattggtaacatgcagaacatataaatcacatgttacaacggctaaaagttaaaattgtatgttcgcggagcatgttttttttatattattagtgtatataaataagttttaaaagcgattaccttaaagggtttgtgttacagcacaactataatataaaaatcagaaaaggactctaaaacttaattgaaaaaggaatttggatgacatagcaaaattgacaacctcaaatcatttattgctttttttcctttttatcatgactgtcattttccagggattctcaattgaacaccaaaacaactctgatgttaataggaaaagacacaagtaatagtatagatactcaactgctgtgtttcaccttttttttttcccctctgcattatctgttgtcattgacaattatgtgtacaacaattaccaccttagattccccaatgaaaagggatgggaaaaacatagaagtgctattaaaccttaattgtgtatgggcgcactacttttagagtatcagatacgcacctataagtctgaacaacatagaaaaaggcaagggtggatttatcattataatacatctgaactcactgctttacttttgacatgtaccataacttgtagaggtctgcgtatttgagtatgattctttgcaaaagtggaaaagaaccccaggccatttggtcaaactactttatactagtagtatttagctacagttgtcatattttgttaaatgcacattttgtaacatctaaatttctaaaagaacagtagagacccaccgcagcgccaccatttcattccttttctcaaaagctctgttttgacaaagaggtacaaaaaaaaaatacgctttaaggctaattggctaatggtttcatagg

SEQ ID NO: 529 - DNA, 4860 bp, Solanum lycopersicum
atttttattacaaattcctaatacaagaaaataaatcacattaggttgaactgttcaattagtttaatgtatatatgtatctatatgtattttattggaaaagtgaatttttttcaataatttttatacacaatttaatataatattaaaatagacaaaaaaaatcatcattaactcctttcttcttaataatacatttctatattattagacaattatcaatcgaacataagttatcaagaactacgatgtcaactacatattcagattgtttttttcttacaaattttaaaagaaaaacaacctgctaattatatcgagtcatattgctatatgatatcaaaaaaacattatattaaaaatataattaaataaataaaaccgtgttctctcgaatcagctcaaacttaaaatggaaagcgagctatatagctagggtataggaagatgtatttaattaaggtaagaaaagtcggttgagcggtgaaactaaattttggttcactaaacttttttcacttgtagaaactgatcaaaacagtaaaaattttgttgggagctaagaaaagaaattgatcacgttagtcaatgtacatcaaataattacacgtgtattcttacgagtagagtctaaaaagaataaagtatatttttatttttatttttatgaaataaaaaaattatttttttgatagttcatcaattcaaaaaaaataaaaaataatcatgaactttattcttaccattataatgcacatagaccttattgttactgtgtgaatataattttcttttataaactgtagacttatcgaaggatagaatatagataaatcgagcttagtcaaaaagtaataatgagaattccatccaccatagaagactattgtcgattgagatatatttattttttcttttgcaaccttagtcttattataaatatatgccacattatattgtaatttgcaaatatacctactcaaaataactcttcctcctccttcactctcaagttcttcctcattcttcttcttattctcatacataaaatgttaaaaatgttgtccaaaatggctatgtgcaaatcccatgggcaagattcttcttattttattggatggcaagaatatgagaagaatccttatgatcctttacaaaatccttctggtattattcaaatgggtttagctgaaaatcaggtaccaaatttatactattatatacaacacactcaactcaactacttagaaacacgagcgtaagttatatacataatcatacatcattacattatactatcaagggcgcaatgtgattaagaatatatatgcatgatgatgaatgatatatcaagagaaaagaaaaaaaatgaaaataattgaacaaagttaatgatgatgtatagtttaaattagtatcatgacaaattatgtgctacatttgctaaatactatgtcttgtttttgaaaaaggttggctttattgcttcatatgatattgacaaaagaccaaccaaaaagtgtttgattgatcctcatgtatctgaatcagcatgcacaatttcttttgttgttgtttctagctatataataattagtaaacatataatataatgtttatatatatatatatgtacatatataatttttttttgaagctctagttataatcttgaattaaattttcttgttctaattaattatattaattaatgaaacagctctctttcgatcttattgaatcatggctcacaaggaaccaagatgtaattcagtttagagaaaatggaggatccatgtttagagacttggctctttttcaagattatcatggattgcaagctttcaaaaatgtaatttaatttcttccttttttttcatttttcttgcataaatatatacatatatattttattttctttcaatcgagtggagtacctgatggaaacagtcgaggagtaggagtaaggtttaagcacactgatcctttactcactcttcaaactccgttcgtgaaatcacactaatatattaaatacttattttaaactacattttattttgctttgcaggtacttgtgtcattcatggctgagattagaagaaagaaagtaaaatttgatcccaaaaatttagtacttacagctggttcaacttcagcaaatgaaacactcattttttgcttagctgaacctggagaagctctccttattccaactccttattatccagggtaacatcaatctcttaaataatattcccttgttcctgtttacgctatagaatttcaaaagtcaattaaatatttctttgatcaattaagctatacacattaatgctaattaggttgtctttttaccagtcattttaacttaatatgtggtaggagttccttttttaccactattctagagtataactcaaacattatattcctttttcgatttgtttgtcttaattcttagaaatagtatttatttaaaaagttatactaaatatttttttaatcgtcagtgcatataactcaaactcttgttagcaagctccatataaattctaagccattatcctgatttttttttctcatgacaggtttgatagagatcttaaatggagaacaggggctgaaattgtaccaatacagtgctacagttcaaataatttcagaattaccgaatcggcccttgaagaagcatatgaacaagcccaaaaacgtaatttaacagtcaagggtgtattcatcacaaatccttcaaatccactaggcacaacaatgtctcgcaacgaactaaacattctaatcacatttgccatgaccaaaaatattcatatagttagcgacgaaatatacgctggcacagtattcgattcgccaaaattcgtaagcataatcgaggcattaatcgatagaaaactcgaaaaatcaaaaatgtggaaccaagttcacattgtatcgagtctatcgaaggatttaggccttccaggtttcagagttggcatgatttattcgaacaacgaaactctcatagctgccgctacaaagatgtcgagttttgggttaatttcatcgcaaactcagtatctattgtctaaaattctcggagataggagatttataaaacgttatgttaagcaaaataagaaacaattgatacataggagggaaatgctcgcttcaggtctcgcaaattcggggattgaatgtttggacagtaacgctggattgttctgttttgtggatatgagggatttgctaaattcaaacacatttgaagcagaaatggaattatggaaaaaaataattagtaacgttggtttaaatgtatcccctggttcctcctgtcactgcagtgaaccgggttggttcagggtttgtttcgcgaatatgtcaaaagaaacactagacctcgcgatgcaaaggattaataattttgttaattctgatagagatattcatcgccagcagccgttacgattcgtgacgggtgctgggtcaaggaggagaaggacaattgcgaattgggttgttaaattttcatcaggtgatggaagaagagatcgttgaaagggaaattgaagatatattaattgtattattgttgtgtttgatataatttgagagttgtagtatagctagggagcatatatgtatttattagtattttattattgtgtagagttatgtgatgtttcaaatatggtcagcctacttggtagctttcatgttttatgtccattttcaaatattataacacgttacttcatatcgcaatcactaggaaatatgagacaaagaaattaaacaaatcagagggagttgttgagattgagacattacttgaataaatttatttgcatcagaatttgcactataagtatagtaaatatgtcttgctttgatttttgacttttatcataaagttgtgtgatttaagttggggtaatgtaagtactaaacacgtgaataaaatgttgttaacatagagagtttggtccaaaatgggggttcaaatccaatctgtccaattcttgaaactttggcattctaaaatttaaggcgccaatagcaaatatcatgtgaaactattttacgattaatcggaaaaaaaaagaacataaaatgtacataagtgataatattcaactaattgattactcatttattatccatatgtaagttaagtaagcttataatgtaattagataaaaggcattatgtaatcatagagaaaataaagtatacatttcttgcgcgtagtctcacttttttgtaataaaataaaattggaaagtaagaataattggttagttgtcattttctttcatttttgatgaatttggagaattcatcatgaatattgaaatgtatcaataaggaatgatcatctaagtgtccaaaaaaggaggagcaggggtgagttacgaatagaatgttaaaaaaagaatataattaaattataaaaatatttttttaactgtttaaaattttagatgagcattcatatactttaatatgacaacagagtaggcaaagactttgaaatttttttcatcttcatccatattaattataaattcacatattatatgttttttataaaatcttaagtttttagtcgttcatatcaaaaaaaaatttcacgtgtttattcatgaaaaaaatcaggtctatacttgagggagtgtattgtatgtgctctttgtaacaatttaaacttttagatgagatgatcagacttcaacaaatatatagataaaattttcatgagatggtcacttaagtagaagtttctatgataaaaaaacaactttttttatttgatggataaaaaaatacttaatcatatttgtatcaacctaa

SEQ ID NO: 530 - DNA, 5357 bp, Solanum lycopersicum; identical to SEQ ID NO: 478
  modified_base (1822)..(2453): a, c, t, g, unknown or other

SEQ ID NO: 531 - DNA, 4800 bp, Solanum lycopersicum
gttaattggtttggggtcgttgtgtcacataagccaaaatgcaaacaggtaatagagttttgagtaataacgagattaaagtaattataaggcttgtataatgttatataattaaggtttattggtttaaggttataatagtaaatttagcagaggcaaagaggtgatagggttttaagtaatactgagactaacgcaatagggtttgtaaatgtcatataattagggtttactagtctagggataaatagtaaatttagtatcgtcttattgggttatcggtttaaccattaacaaaaatcataaaatcagaaatcgaatcgataacctaataaaaaagtttgtgaaacctttaaaaaacagttaacccaataacgttccagctaatcaagttcattccagctccctatgagctcatagtcgctggaaggaataaaagcttgttccatcaatatcaataaaccaataatatttctcgattcgattcattggttaaatagatttttgcatacacatacatatattcgaaagatgaagcttgaaagtcaaagaaaaaaattttaatttctgaaaagaaaaatcactttattgttgctcaaaaataatgatttttaaaaacttttttaaaagttgttagattacttttagttaaaaagttgttaaaaaagtgctttcttccttaaattaagtattttacctacaatcctcaataaatatcgatcatacttcttcaattcgtcggatacatgtatcaaacttatgaaatatcatataaaataatattcgaaataatcgtaaatgttagtaataattagaatctaaactagctttatttgcgcaatttaacctaatttagaattcctactccaagaagaagaagcataagagaaagtgagagagtttcgatgggccgaaaaatggggcccacggcccagccacggattttagccctatataaagcgtcttcgtctcatgcaaatctcgctcacttcataagctgttagtttcacgttctcttcgcaatttccattacagccgctaggtttccgtccacttcttcttctccattaatatctgtatggtgttcttcttttttgaattctagattttttctttgaattcttgttaatctttaattttctttgtttaaatcaagaaattagcttcttctgaagtcagggtggggatttttggatcgtgtcaaagtgtgttagagggtgattatcttttgattcacttgtttttttgcttcttttgagggggtagccggggcctcggcctcggcgggttttaatagcccccaactattacaacattgggaagaagaacatcaatctgtacaaacccttaagttagtttttctttttaattctttgattctttcttcttaacaaatcaaaacagatcggggaagagatgccggccttaggttgttgtgtagacgcttctgtttcccctcctctcggctatgccttttcttgggatagctctcttcccgcgccggagttgttttcctccggcgtacctccggcgacaaacgccgccgccgtttccaccggttctcattggtctacggatctgtcatctgatttgtaccgggtagatgggtggggtgctccttatttctccgtgaactcttccggggatatttccgtccgtccacatggtacggatactcttcctcaccaggagattgaccttcttaaggttgtgaagaaggcttctgacccgaaaaatttgggtggacttgggctccagatgcctcttgttgtccgttttcctgatgttctgaagaaccgtttggagactctgcaatcggcttttgacatggcgattaattctcaaggctatgaggctcactatcaaggtgtttatccggtgaaatgcaatcaagataggttcgtggtggaggatatcgtgaaattcgggtcgccataccgattcgggctggaagccgggtctaaaccggagctcctgttggcgatgaactgtctgtcaaagggcagtgctgatgctcttcttgtttgcaatggtttcaaggacactgagtatatttcgcttgctttggtcgcaagaaagctccttttgaacagtgtgattgtgcttgaacaagaggaggagcttgacctggtgattgatatcagccgtaagatgtctgtccggcctgtaattggacttcgtgctaagctcaggacaaagcattctggccattttggatccacttctggtgaaaagggtaagtttgggttgacaacaacccagattcttcgtgtagtgaagaagcttgatgaatctggaatgctggattgtctccagttattgcattttcacattggatctcagatccccacaacagagttgcttgctgatggtgttggtgaggccactcagatttactctgaattagtccgtcttggagctggtatgaaattcattgatatcggaggggggcttggaatcgactatgacggttctaaatcaagcaattctgatgtctctgtttgctatagcattgaagaatatgcctctgctgttgtccaagcggtcctctatgtctgtgatcgtaagggcgtaaagcatccagtgatttgcagcgaaagtggcagggcaattgtttctcaccattcaattctgatttttgaagccgtgtctgcttctactagtcatgtttctacacagccatcttcgggtggtttacaatccttggtggagactctcaatgaagatgcccgtgctgactacagaaacttatctgctgctgctgtccgtggagaatatgatacatgtctcatctattctgatcagttgaaacagagatgtgttgaacagttcaaagatgggtccttggatattgagcagctcgctgcagtggatagcatttgtgattgggtgtcgaaggctatcggggttgctgatcctgtccgcacttaccatgtgaatctgtcagttttcacctcaatccctgatttttggggcttcagccaattgtttcctattgttccaattcaccgtctggatgaaaagcctacaatgagaggaatactgtctgacctgacgtgtgacagtgatggaaaggttgataagttcattgggggcgaatcaagcttgccgctccatgaaattggaagtggtgatggtgggcggtattatctggggatgtttttgggtggggcttatgaggaggcgctcggaggactccacaatctatttggtggaccaagcgttgttcgggtgatgcagagcgatagccctcacagctttgcggtgactcgctctgtccctggtccatcgtgtgctgatgtgctccgggcgatgcagtttgagcctgaactcatgttcgagactctcaagcaccgtgcagaggaattcttggaacaaggagaaggagaaggcgaaggtgttgcctttggatctttgaccagcagcttagctcagtccttccacaacatgccttacctttcgtcttgctgcttcactgcagaagccactgccaatgccaataccaataccaataatggtggctattactattacagtgaagacaatgctgcagcagaggaagatgagatttggtcctactaaactctgcttgaagtgtctcttgttagcatctccagtttgttttagtttgtggtcgaggtcgtctgtttttttataataatcccaccccttagtttgggtgcatgttaattacttttgtttgcaatagatgcagtagactgtcatctcctattgcaactaagcttatgttatgaccgcaatcagttttatattaatgctgtctttttttgtttcaagtattgaatcgcctccttatgtttgatgatggtgttaattgaatcgcctccttacgggggtaggtggcttagattcgttcatgataatgttttattttgtacaagggagtagtaggtggagctgtatcatttttaacttgttttaagacattggttcatcttggcacgtagtttaagttattgttgacatagagtggcctttgaaacagaaaaagagttttgcttttttggtcatggtggtgtgcgtataaaattcaatatattttatttgcttgtgttggcaagaaagatacgaattgccccatatatccactaccataccataggaatgaagataacagatttctaatgttgctttttgtacagtgaatgagattccttatcggcagaaacactgccatcaattagtgagaatattatagatgggacgcctttttatttttgtttctgcctaattgtttttcaatatagtcattaaaacctcaaaaatctacactctttcattgaccactaagccacatatttaagtgtgtcgtcttttaacttcctacaccggaaataaggatacgatgggatataaagtgataaacggtctttatatccgtgttgttagttgtcattttccttgccatgcagagaagactcattgggccagcatataaaattgggagcccataaaactccttttgcaagcccatttatataagactgtgaaacaccagtcaattgcaggttcagtagtttcaactttcaagcaatcaaagagaaacaacacacacagagagagcagaaatggcgataacactgaacagcggctacaagatgccgattgtgggattgggtgtttggcgaatggaaggaaaagatatgaaagatcttctcatcaacgccatcaagattggctaccgtcactttgattgtgctggtaaactactttttcttgattctactttcttgctcttttcattcttgaatcttgattatatacatagaaatagttcct

SEQ ID NO: 532 - DNA, 4738 bp, Solanum lycopersicum
  modified_base (4526)..(4738): a, c, t, g, unknown or other
atgtgatactttactattttttgaaatagataattttatcttataattttaattttttataaatattttaagttattaattattatattttctattttaatttatatggctagtatttttgtccgtttaagaattatttaacacaatttatatttatcagtaatattttaaatatttattttatcttttattacaataatttataagtttcataaatatttttataacttattttagataataaaatatttaaaaaatttctttaaaatttcataccaaatcaaactaattcatatgaattgaaataaaaaatataaatttataaaaaaatatttctcctccaaatatatatttatcaaaatttaaataatatcaaataaattaatcaaacgtacaaactagtaaaatccgtgtggttgattgaaagtgataataatgcctcccccaaacaaacacagaatcatcaaaattcaaacaccaaatggaatcaaagataaggatcgatgacttggaacaatcatgaccgttggtttctaataaaaatcccaaaccatgggaaccttcgaagcaccttactccattcggtaagcactcatgtaatttttttctttatctatttttatttgttaaatatattaaaactaattatttaattactaaaataaaattaaaaattactcatctatttattattatttttttaataaaataatttataaccaaacaaatttttattcattattttagactataagtcttaatttttttttctttttcaaagacgagtcaaattaactcactagagaaccaaaaaaatatagtaaaatcaagcatcggacaaataaagttgagcagagaaataattatataccctcttatcttctcgcgatgtccaacgccacgcggcaacccgactttgttagataaggcccaatccaagcccatgacccggcccaatctatccattataaaacgaacggaaccctcccatgcaaatcttgctcatttcgcagttgtttacagttttcctaaacggaactctaccatctcttttttccggttaccgtttaggtttccgaccaattttcttcttctccggtgaactattccggttaaaagttgtatggtggggtgtttgtttgaatcttaggtttgtgtttctgttggttttgagttttaattctttgttttgatttagaaaattttgcttcttctgaagtcgttgtggggatattcgggtcgtgtaagagtgtgttagaaggtgattatcttttgattaagttctttttttgcttcttttgagggggtagccggggctctggcctcggcgggttctaaagcccccagctattacaacattggtcaacaaatcatttctgtataattagttttacacattctttgattcttttttttttgtgaagattttacgagatgcctgctttaggttgttgtgtagaatctgctgtttcccctcctcttggctattccttcctttccacgccggagattttttcctccggcgtacctccgtcgacaaacgctgtccctcttaccacccattggtcaccggagctgtcatctgatctgtatcgtattgatggttggggtgctccgtatttcaccgttaattcttccggtgatatatctgtcaggccccatggtacagatacccttcctcaccaagaaattgatctcctgaaggtcgtgaaaaaggcttccgacccgattaattctggtgggctcgggttacagcttccactcgttgttcggtttcctgatgttttgaagaaccgattggagtctcttcaatcggcttttgattatgctgttcaatctgaaggatatgaggctcattaccaaggtgtttatcctgtaaaatgcaatcaggacaggttcgttgttgaagatattgtcaaattcgggacgggtttccggtttggtcttgaagctgggtcaaaacctgagctcctcctggccatgagctctctatgcaagggcagctcggagggtcttcttgtatgcaacggattcaaggatgcagaatacatttcacttgctttggttgcaagaaagctccaattgaacacggtgattgtgctcgaacaagaggaggagcttgatttggtgattgacatcagccgtaaaatggcggtccagcctgtaattgggctccgggctaagcttaggaccaaacattccggtcattttggatccacttctggagagaaaggcaagtttgggcttacaacaactcagatccttcgtgtggtgaggaaactgaaagaatccggaatgttagattgtcttcagctgctgcatttccacattggatctcagatcccttcaacggagttgcttgctgatggtgttggtgaggctgctcaggtttattctgagttagtccgccttggtgctggcatgaaattcattgatattggtggtgggcttggaattgattatgatggtaccaaatcttccgattctgatgtttccgtcggatatggccttcaggattacgcctctacagtggttcaagctgtccggtttgtttgtgaccggaagaacgtgaagcatccggtgatctgtagcgaaagtggcagagcaattgtatctcatcactctgttctgatatttgaagctgtgtcttcaactaccacgcgttctcaagagctgtcctctatgagtctccactccttcgtggagaaactcaatgatgacgctcgtggcgattaccggaatctatctgctgctgctattcgcggagagtacgatacctgtatgctttatgccgatcagttgaaacagaggtgtgtggatcagttcaaagatggtaatctggacattgaacagcttgctgccgtagatgccgtctgtgactttgtgtcaaaagctattggtgcttctgaccctgttcgcacctatcatgtgaatctgtccgttttcacttcaattcctgatttctgggcaatcgaccaactattcccgattgttcccatccacaagctagacgaacatccttcagctcggggaattctatccgacttgacatgtgacagtgatggaaagatcgataaattcatcggaggcgagtcaagcttggctctccatgaattgggaagtggaaacagcgcaccttattatctgggaatgtttttaggcggggcatatgaggaagccctcggcggactccataacctatttggcggaccaagcgtcctgcgtgtgtcacagagcgacagccctcacagcttcgctgtaacctatgcagtccctgggccttcctgtgctgacgtcctccgagcaatgcaacacgagcctgaactcatgttcgagaccctcaagcaccgtgcagaggaattcgtgcacaaggaagaagaagtagaagtctcattggccaatagcctaaatcagtcgttccacaacatgccatatcttgcaccacattcatcctgctgtttttctgggtattactattgcaatgatgagaatattgttggtgttggcgcagaatgtgcaataggggaggaagagttttggccatactgcgttgcttgaagactttttgtcttttcagtttgttgttttagtaataaagtttgtcggatggtatgttaaattaatgtaaatttttggtgtaatttactagttgtggagaaagttatggttcaatctttgtgtaattttctccttatcctatgtaaactttttccttattaaatgaatttactttagaaattatctatactgtttttcttattccaatttccgtttagtcgacggttgatttttgtttcctgcagtctcatcaatactatcttttcaaaggatcataacattcaaaatgtttaggtactcatttgtctttaatgaattcaattttttgaattaattgtattgcctatcattgctacataattttatccatcaataatacaaaatgacaaaataaggtatggaatatagttactattaaaaagcataaatagttcaactatttttatatatagactacaataactatatatataaaatataaaaaagattgttttcttaccataattcaaatcatcgatgaggagttcgatttcaacgggacctactgctacgctatgagattctctttgtcattgaggggttcaaaatatatatgtccacataaataattcgaatgaacctcctgaaacctacttgggtctgcccctagatacaataacataatgtttaaaataacaacaccatatcaaccaacaggtaacaaccatccaaacaagaacgagaaaatgaaccaaatgttccatagtatatagataatgcttcattttggtttttaatgtatttcataagattgaaatgatccttaatgtataataaaaggtgttcattttggtcgtttatatattttacttgattgaaatgttttatcaagggaaaagggtctgatatgccccttaactttgtcatttggagctgatatacccctcgttataaaagtggctcatatatgtgttaggatcgaattcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 533 - DNA, 7193 bp, Solanum lycopersicum
caatgaattattctatacaaaacttgatcaaggtagtttgtattgttatactcatattttaagtttttttgtatattcaactagttatatatgtatataagtaattacttttaaaaaagatacacttatttgtataataatttgttttaaatcacaatttttttatactttacgttattatatacaaactgcttaatggatttgtgtatatacaagtactatattcatatttttatttatacatatacaattacttatatatgtatataataattaatttaataaaaatcaaacaatttatattcattttatttacatttgtatataaatttgtttatacgtatacaattttttgtatatttattttattaacattcgtatataaacttaaacttttttttatacatatacaattttttttatatattcaactagttatatatgtatataagtaattacttttaaaattttggtacaattatttgtataataattgttttaaatcatattttttttgtatttcatattattatatacaaaactgcttgagggattcgtgtgtatatgtatataataattaatttacaatttggtgcaaattaaataacttatattcaatttatttacattcatatataaactttatatatattaaaagtttaatttccccataaacaagttttttatgaattttcagtcacaatagaatttttttaaaaaaaatatttttaaatgtttaacttaaattatgaaatgtgtaaatgtttgttaaccatatttagggctattgttattatttaatgaaaaataaaatataatataatttttaaaaaagtattttatataaaataaaaaattacgtaacaaattatactatacccacaaaatataattatgtaaactataccatataatattatttcgtaaatttagtttgtcatataaaattttccctaaaatgaacagaaacccattagttacataaactgcgttttgaaaacgcagaaactcgcggcggcagtcttgttccgtacataatcttggtctgcaataatgggagaagctctgaagtacagtatcatggactcagtaagatcggtagttttcaaagaatccgaaaatctagaaggttcttgcactaaaatcgagggctacgacttcaataaaggcgttaactatgctgagctgatcaagtccatggtttccactggtttccaagcatctaatcttggtgacgccattgcaattgttaatcaaatggtcagattcacttctttcttttaatttacgctaaaaaatttgttgctttatgcaaattttcatatttccgtatcaagattttttttccagctcctatgatattgaatttttttcacctcatccgcatatttttttgggcttagtaataaagttaattgctttacaccgacaatatttgggtttcaactactctctccttcccattttatatgactggaaacagagtttaagatgttagattgacttaatattagtatgtcattagtcttggtagagaaattatcacaatgaagttttattttgctgtaattaatttggattctaaaagatcatgaaagttgtatagatatggaataatatcagtcatgttttggaagtcatgaaatatagcaagtagcagtggaacggtgaaagttaaaaatttagagttgatagaatagttttgtaggcaaagtatgttaaaagaattaatcctaaaatagaaagaatgctaattaagttggaattggtgggtatagatagtatgattcatggtacttgtatgcaaattggaagtatgtaagacttatttcaattcaattaatatctgaatttacttcggaaaatctgttcaccctcacaagttaaacctcaccgatcttttaacagttgatgatagtgcttcttaaaaaatgttttgactttttataaacaggttacgttctttcatacacttggaagttgttgaactagttttgaagttcttaaaattgattctagaagtttgaaatttgtgtttttgtttgggggtgtgatgggtttgaagctagattggaggctttcacatgagctgcccacggaggattgcagtgaagaagaaagagatgttgcatacagagagtcggtaacctgcaaaatcttcttggggttcacttcaaaccttgtttcttctggtgttagagacactgtccgctaccttgttcagcaccggatggtgagttgcatttaagtaacagttccagtcgtttctgttctactaattcttttaagtctgactgtgttgtaccattaagtttgaatcttgtgggcttcttttatttgagatcatcttaatatatcttctcaatttttttatgtcctctccgtgtacactctaaagctatacttaccacactaatactatgacatcctcttattcaacctcaatactcttcatatgatttattatgtcaagcactgaatcgctgctatgcttggtttgtattaattgaagatcaagccttttgacattatttctcatgttccctatattccttgtctctctgatttattggttacaaaaactagaatacctcatccttctatctgccacacaagtactaaatgatatggtagaaaattattatctttgcgtcttagatttcagctctcatgtttagcattggtctaaagaaacttttgttaccatatggaacaattttctattaattattgtgtcttggaccttagcaaactgtcttccctccctgcaggttgatgttgtggttactacagctggtggtattgaagaggatctcataaagtgcctcgcaccaacctacaagggggacttctctttacctggagcttctctacgatcgaaaggattgaaccgtattggtaacttattggttcctaatgacaactactgcaaatttgagaattggatcatcccagtttttgaccaaatgtatgaggagcagattaatgaggtatccgctcttgtctgattcagtgttagatcatcccattacttgtttaatattggctgaagctttaacattcaatctggattctgctattactttcaaatacaaatggattttttacttgggtcattgcgtttgtgatattctttcaaatgtgataatacttatcttagctttggcttgtgatgatttgtttatcttctttttgtgatacagaaggttctatggacaccatctaaagtcattgctcgtctgggtaaagaaattaatgatgaaacctcatacttgtattgggcttacaaggtacatttctaatcacttccctttcattacatatttgatgaaattgtaatactcaagttagaatgccaaatctgtcccacatatataatagttacctctccgccgtttcattttgtaaggtgcttttcaaatcacttcccttccgttccatatttgatgaaattaaattggtgaagttagaatgccaaatgatctagctagtcccacatatataattaattattagttacgacttcccctttccattttattggcatagtttgattggacatgaagtttataactgtaaagaatactgttgaatcttgtgtcataaactaaattttgtatatcatgccaaaaatatccgttgaatcttgtgctcttaaatatgtcatgtcatttatgtaagtgagtggggagtgttattaagggtatgttgaagttaaaaacttactaaatatagaaagagacattctttttagacaaactaaaacgagaaggcacataaattgaaatggagggagtaatattgggatgatattttgataaatgagaaagtaagagatatttacctgggagaaaatggatttgcatgcattgtggtagcaaattcatcgttattgagatcagaaagtgaaatcaagagggaaggataaaaggagaagaaaccttcattttttattttttttgaaataatgaggattcatctagctgaccccatcccgtttgtgactgaggcgtagctgttattttcctatattttttttgtttagacgccatagaaccccttaaactatttcctttgaattcaagaaagaaaaagaagtacaacattatatagaaggaaaaagaaagtttaaaaaaggatggatacaacttcagaattctggcagatttttgcaatacttaatttggaggatatcttttgtgcagaaaacatcaataacagttttttctcttatcagatcctttctgcttgccaaatgcacaaaacttcaggaaagtagcttctatcattattcccaggttttccttgcaattaagtagtacctttgtcattctaggtactaaacgttgttatagttttcgtctttcaggtgggaataatagggatagggttgaggatatcttccggaacacctagctgttgttttctggaaaatattgacttttacctagcaaactttacattagtactcaatagggaagaacagaataggataggtctctttccaaagggggggggggtatgaattgaaacacaataccttattttttggatggaaaattaagtcatcctagttaatcttattattattattttggtttttggactcggctgatgttgtaaatagttcagcaatctatcttagtgctgttttgacaaactgaaaatcctattaccttctcaaaaataaaaaggatgtagaaatacctgttttatctctagatattccaagtgaagttttttcacaagcagaaatattttgaatttctaatagaataaatcttgtttccatgaagtttctaaagtttgcccctacaactttatttttttctttcaatccggaatttgctgtagttgcacgttggggtgtgataccagaatactagacaatgggatgaactaaggcatgatctcactattatccattccactatactgatttaaagcccagcgattgacatattatgataatttttggatgatcagaattcagaggttcatcgtggaaattttttgaatttttacttgggcagtttctcgggaagtcatattcactctattatgaagaagggatgatttcatgctttttcagcccagaaaataaaaggaaaacatgcattctcttttagttcatatattaatgttactctcgtatttatcatctcagaaccggattcctgtcttctgtcctggcttgacggatggatcacttggtgacatgctatacttccattctttcaaaaagggtgatccagataatccagatcttaatcctggtctagtcatagacattgtaggaggtatgagtatcttatcaagtgattctttcctctcatcaagaatttgtttgatgaaagagctaacatgattaagttatataaccagatattagggccatgaatggtgaagctgtccatgctggtttgaggaagacaggaatgattatactgggtggagggctgcctaagcaccatgtttgcaatgccaatatgatgcgcaatggtgcagattttgccgtcttcattaacaccgcacaagagtttgatggtagtgactctggtgcccgtcctgatgaagctgtatcatggggaaagatacgtggtggtgccaagactgtgaaggttaacaacttacctctaatacattttgtgcaagcatctcctttgtgagattctaatttgttgtagtgtttttgatttgttgaatgcaggtgcattgtgatgcaaccattgcatttcccatattagtagctgagacatttgcagctaagagtaaggaattctcccagataaggtgccaagtttgaacattgaggaagctgtccttccgaccacacatatgaattgctagcttttgaagccaacttgctagtgtgcagcaccatttattctgcaaaactgactagagagcagggtatattcctctaccccgagttagacgacatcctgtatggttcaaattaattatttttctccccttcacaccatgttatttagttctcttcctcttcgaaagtgaagagcttagatgttcataggttttgaattatgttggaggttggtgataactgactagtcctcttaccatatagataatgtatccttgtactatgagattttgggtgtgtttgataccaaggaaaaatgtttatttggaaaacaattggatttttaatttattttttcttgtttaataggtaagtagagaatatttattaacgtttggttgatgaatgaaaaatattttgagaaaatataatttatttttttattttgagtttagaaaatattttttatgaaataatttttgattcgaagagtaatctcgataattgatctatgatcacttgaactaggataagactccaaccatccctccatagtcgacttttgagatttgattcatgactagacctttgaccatgaaaaatgaacatttttttttcataaactattttgtatggagtaagatagaaaaatgaaatcttataaatttaaaatatattttaagaatattttttctgtggtaagatggttggatggtgtgaaataaatctcaaaattggctgaagtcattttcggtcctctaaagttatttgcataattaatttagacagtctaacttatctatgtatcaattgaacaccttatttgttcaagagacatttctattagacacataatgctgaaatgacaaaaaacgtgtgattcactttttttgaacgtgttaagttattaaaaggaaaattcacacctaaattaataataaaaaaaaagcaaccgtcttcttccatccctgcatttattatttcatcatttttcttataaatgcgcacaccacactctcttctaactctctctttctctcacctctccatttttcttcttatttttctttttatattaatttacgtctcaatgtctagataaagtctattttattacatgaaaaaaatataaaaaaattttgcaaaaatttgttattatttgttccaattctaataaatagttactattgaatagtagacgaaggctatgagtaaaatactttcatgctatcaaaatgaataagaaagaatatttagcatgaacggatagcaatgttgtattttgcactgtagacaccaatgaaagagaagaaagaggtagagtgatggtttgctggtattgtcggtgccgacatctgctccgtaa

SEQ ID NO: 534 - DNA, 4000 bp, Solanum lycopersicum
acgcatgaaacattatttagttttaaaacttgagtaatgtacattaatttggtgtcttacctattataggttcaaattcaaaggtataattgttagatatgaaacccatatggaacactttttttaattagattagattttactataaatatatcgaataaaatgaaaaaaagaagaagataatttggtgtctttgtaagatgtgccaacttattgatccatgtgattcactaaatcaaatgtatgtgcttgcaacttgcaaaactattggcaccgttagtttggtaaccagttttaggcctcctgagtcctcataaatgattttagaccaatcgcgaaccgaggggcataaaggtaattaagctgattatttagttttactgtttctcgaattatttgtttacttttaaattgacatgctcattaaaaaagtaattattaacacaatgaagttataattttatctatattaattatgaaaaaaatgaattaaaaattcagatttttttaaaaaaaatttaaataattaattgaaattatattttgttctaaaaaaataaataaataattatagagagggagtaattaattaaagtaaatataggaactattttacaaaaaatatagaacgagtggttcgcgaaggttcacgtgacacgtgctgaattccgcggcatcccaacagccacgactcgactaaataattgccacgttaccatattaagagatttttaaataaatagactccctattgtctaatttatttgatttacttaaaaatgtctatcacttattttattttcgagagatagtaattttgtaaaagaaaatttataaacttatctatcaagttacatttattttagaaaattaaaggatatagtataaaatgagatgaagagaatacaacacgaaaaaggagatatactagaaatatctagagaaggcttataaatactcgagtagctctgttgctaacagatttctgattctaataatcctctacaagctttttgttaagagactaaaaaaaacaaaaaaaccttgaagaactcaccaatttgatcaattcatttattaaaaaaaaaacagagaagaaaagaggtatgtagcctaatttcattcattcaatttcatctatatgtgatttagtttggtcagatcaatcttttcttttcttgcttctttttaatgttatctgaacttatgtttaagtacttctcttatctttagagtcttgtgtttcttgaaatggattgtgatattgctcttaatgatgagtaattctatgattgtataattaattatagttgtggggagtaaaatgatatgttttgtctacttacagaaatggctattatggatgaagctgctaatatggtttgtgtgccgttggattatagtagaaagaggaaatcaaggagtagaagggacagaacaaaaaatgtggaagagacactagctaaatggaaggagtataatgagaaactagacaatgaagggaaagggaagccagtgcgtaaagttcctgctaaaggttcaaagaaggggtgtatgagaggtaaagggggaccagaaaattggcggtgtaaatacagaggtgttagacagaggatatggggtaaatgggttgctgagattagggaacctaaaagaggtagtaggttatggttgggtacatttggtacagcaattgaagctgctttagcatatgatgatgctgcaagagctatgtatggtccttgtgcaaggcttaatttgccaaattacgcgtgtgattctgtttcctgggcaactacatctgcatctgcatctgcatctgattgcaccgttgcttctggtttcggcgaggtatgtccggttgatggtgctcttcatgaagctgacacaccattgagctcagtgaaagacgaagggaccgcgatggatattgttgaacctacgagtattgatgaagatacgcttaagtctggatgggattgtctagataaattaaatatggatgagatgtttgatgtagatgagctattggctatgttagattctactccagttttcaccaaggactacaattcagatggaaagcacaacaatatggtatcagattcgcaatgtcaggagccgaatgcagtggtagatcctatgactgttgactatggctttgattttctgaaaccaggcaggcaagaagatcttaatttcagttcggatgaccttgcattcatagacttggattctgaacttgtcgtttgatagttttcgcagttgaaagatgcaatgcaagataacatgtatcgtcattgattgagatataggacgcgaggaagagaaaactcgagatgttgagtttggacaatgttttcgtatcgttcaatttttttttatttcatgttgggcagcattggttgcccttttcccaggccagctgattctcgataagtttttgcatcgaagattatgcatttggtgttctggaggactaatcttgtacagatctaaccggcctagtgagtcaataattgttcgttttggtgtgttgatatgacgaataaagatgtttctgggattcatagtttgttgtaaagtttgcttgacaattagaggtactgatttttgtgctttcattggaacaatgtagaatgcattgacggcatttacagttcattcataacttgaacaataagtttggcagtgtgtatttgtgttactttgtgaagtattcccaggggattcgccaacgaatgctgtgttgtgtgttcaagtgtttcgagtagatcagagaagtactggaagcagtggtgctatagtgttttatgttagccctcatcgtggtttggtagatttgtgtagttctgttttgcacttaggcttttttatctctatcagaagttgtactcaggatgtaatagtagacgttttgagacgtttcaaaatgttccagttcatgttctttaccacattgtaattcaataaattctgcggtaatcttaagatgtggaatgtagttgttctatcaaactaactcaagctttaacacctctacttcagcatttctctttctgttttcagtctctctctattctagtttgaactatcaatatggcttagtcctgttgataggattgaatttatttatggagaaaagaacaaaatattggattttttttttaaaatagcaatattttaacatttagtagggtgagttgtcaacacttttaatatttatttaaaatgtcaatattttaatttgttataatgtaattgtatttatttattttgaaagttacaaacttttaataacatagtggagagaattatggaagaaaatatttttaaaaaggtaaaaatattttttttaattgtttattcttacttaatttaattttttaagatataattttgtctgaaatgtatttggatgaacttctttaaatatggttttgtgtaatcggatgaatttcattaaagatgatcttgtgtattcgaaatttcgggtgaatttatttttacaaattgagcacgataaatatttattttaattgaagaattagatcatacaattcaaaacctgattgtataccattaagacgaattcaaatttaaatctgattacaaactagttgatatataaagtaatattgaaaatacaaaatgaattgtataaaatacaaaatctattttactaatgcaattagtatggatacttgtataatacattcgcaaataaattgtattttgattattcaaaattaaaaatgaatacaatatcaaatctaaagaataaactaaatggtatacaaaagggatattgaagatacaaaataagtaaaatgaaatacaaaatttgttttactacaattaggttgaatgcatatataacataaataaattgtattttggttatttagaattggaaatgaatacaaaatcaaatataaatacaaaattggatggcaatacattaggacaaatacgaaatcaaatataaatataagctctt

SEQ ID NO: 535 - DNA, 10138 bp, Solanum lycopersicum; identical to SEQ ID NO: 483

SEQ ID NO: 536 - DNA, 6159 bp, Solanum lycopersicum; identical to SEQ ID NO: 467

SEQ ID NO: 537 - DNA, 13790 bp, Solanum lycopersicum; identical to SEQ ID NO: 306

SEQ ID NO: 538 - DNA, 4860 bp, Solanum lycopersicum; identical to SEQ ID NO: 494

SEQ ID NO: 539 - DNA, 2625 bp, Solanum lycopersicum; identical to SEQ ID NO: 495

SEQ ID NO: 540 - DNA, 5224 bp, Solanum lycopersicum
aaaatcccctcatcgccgatcctcatcccgtcccccagtcctcgtccctgtccccttgtcagccctagtgtaaacaaatgtttattgttcccttattagaaaggtcataactatttggaaaagttgcaatccttcaaaattgtcacaacctttcataaagatcataacatttcataaagtaacaacttttcattaaagtcataatttttcataaaaaatttaacttttcataaaaatcataatttttcattaaagagagggctagttttgaaaataaataattttaaatgcggtggtgccatgtaggcagacctagaatttcctcttatataaatatatgattagtttgaaaaatacaccctctctctctctctcttttgtttaaaaaaattttgacatcacaattcacatgaacaaaacattctactttgacaaaaaattaataaattataatctaaaaaaaaagaattaggtctgtttttgaccctcaataaataaagaattttaaaacttgtgatctaaaataaatgggaacatgaacaagtacccctaaactatgatcaaaatctcagatacacaccttaactaacctaaagttctattacccctgaattttattttttttttgtaattttatacaccttttatcttatgtggcacacttcgttactcaatgcaattaaggcgcatgggagatatttggatgtcacgttagccaaatatatgcacaaaattattttaaaaaataagttcatgagataaataggactttacaatagttaaggtgtgtctctgagatttcgatcatagtctagaggtacttgtaaattttctcaaaacaaatcattaatttttatgtgattaaatttgtagtaacaatttaactttaaaatatttatttaacatctaataaaatgactttcaaaactatctaaatttgtattacgttagactaactcatataaatcgtaattgaggtaaataaatagtgttttattagaataattatctgtagcccatttctcaagaagccaacaatggcttcaacttgtctggatgtggtactgaatccgaatttgattccttctgttatgttacttgcttcagtttcatttgcatatttgactcttttttattacctttgattgcagagctttcttgggaatttttgcaacaactggagtttcagaccttgtacaagactaacaccttgcatttcccaagtgggtttttccaagttcaatttttctttatatattttttcgaatttctccaatatgataatcatagcttagaaatggaagaatttgataaaatgtaggttgagattagggctaagaaataacataatatggcttagggcttatgatgtttcttgatgttagcatttattttctttttgggtgaaatgtaggtttgagattttcaattttgcatttcaattgatgggtcaattagaattttgatacttcaggcatacatttcatttggagagattcgtattggtttactgtaggtatcttcagattttgtgtctttgtatctgattactgaaacactaaatacttggaaattcttgtattaagatttggtaaaaagaaatgttgcgatgattatgtgaacaactcatttgattatatatcattcatcacaataaggtcttccttttcaacgtttaacgtgggtattagttgaacatgtattgcaggtaaggaatagtttattgcttgggaaaaacaagaactatactagctctgtaggatataagggaattccgttaacagaaatttcttgtgttccaagtgctgttgcgagttctagtgaacttcctccacttgttagtgctttaaaagcttcagctgaagaaaatgctgcaagttttcattttcctggccataatagaggacaagcagcgccatcatcactaactcagctcattggtgcaaaaccgtttcttcatgatatgcctgagcttccggagcttgacaatctgttttcaccagaaggtcccattctcgaagcacaaaaagaagcagcaagactttttggagcattggaaacatggttccttgttggcggtagtacatgtggagttcacgcggccattatggcgacttgttcacctggagatactcttattctcccacggaattctcatatctcagccatatctgccatggtattgtctggtgcacttcctaagtatatcgtccctgaatatgatttcaaatgggatgttgctggtggcatcactccatcacaggcaagtaaaacatcctgacatgcatctttatcaacgtcgtctttatgcaagaattaaatgatcttgaatgcattagtggaacgatattttaagtgtaaaatcatgcaaactagtgataaatttataaaagtgtttgaaagactattacacttgtatccgtaaaagaatgaagttcttgttatgtaggtgaatgatgcaatcaaagagctagaaatggaaggccgaaaagcagcagcccttttggtcgtctcccctacctatcatggtatatgcagcaacctggatgagatttgtcatatttgtcattcgtataatatccccgtaattgtcgatgaggctcatggggcccatttaggatttcatccagagttgcctagctcatccctcagccagggagctgatcttgctgtacagtctactcacaaagttttgtgttcgcttacgcagtcatctatgttgcacatgcaaggaaatcttgttaatagagaaagaatcagcaaaagccttcaaatgcttcaaagtagtagccctagttatctgcttttagcatctctggatgctgccagggcccaattaagtgaaaatagagaggctgtttttgacaaagcaatggacttggctctggaagcaagaagcttgattagtaaaattcctggaatctcaatcattgagttcccaagtttctcaagttttttccagatcgacccattgcgactcaccattggtgtatggcagttaggtctttcaggttttgaagcagacgatatcttgtgcaatgattttggtgttgtttgtgaacttgttgggaccaaatcttttactttggcatttaacttagggactcaaagagatcatgtccttcggcttgtagctggtctaaaccatctatcacaaacttctcactttcctcaacctgtgaaagaagaaggcaaaaatgtaaatcattttgtatgccttgatgatattagaataagaatgagtcctagagaggccttctttgctacaaaacgtaaagtcagcataagagatagcctcggtgaaatatgtggagagcttgtatgtccttatccacctggtattccagttctaattcctggtgagatcatcacagcggaagcattgaattatctcctggagatcagaagcaagggtgctgttattaccggagcggctgatttctccctatcatcttttgttgtatgtgttacctaagcattcttccgtcaccttaagtaagtagttcatgtacaaatacgagtgactttggtgttagaccaccctgcatttggctttagagatcttaagcctttcctatattgcaggcagcggcagttttgggtatagttcaagttcaaaagcaatatctttcagagctttgaatgggaactgtcatgagcctattaaaggaaactggtaactcaaaggcacattaatgaaactattatgtggacatggctactctaggtttgttttttgataaaatcaaagacattcatgttgtctctattaatgctcgtcacaacattgatatctgagggttccacattcttcttttcctcattgtatgtataattctggtcaaacgaaggtggacgtattctctatcagcaaagcaagaggcaacaagatgatcctcatcaaactggacataagcaatacaagcaggtgaagaaagagaaacgccggcaagctattactcattagatggcatttccaattgacattctttagttcatctaaaaccaacatgctctttagtgtatgctattcctcttttggggactgttagctatttggcttctatgttgagttaagaaaccttgtaatcatttggggtggctgagagattgtttgggagaagtggtggaacaatgagaatatgtagcaacccatatattatttcttctacaatggaattattttcttctgttgcaagctgggaagataaaaaattgcatgtactttgtattcttgttctgtttcttttttcattctgatgatagaaacatggcatagacattaagattaaggtgttgtttagttgggaagaagttgtaccatgattatttatttcgggataagttatcctaggataagttatttcatcgtttatatatgacaactggagttaaaggtcgagcttcaatcagtatatatgggataacttataccatcactaaagtataaatggcgggataaataagtttaagattgcattattaaattttatactatacgccaaacgactcctaagagaattggaacagaatgatgataatcgttgaaaagatggaaaatgaagtaaaaatctagataatgaattttggagattttcttaaacgggccaggtgacaaaatttctttttaacaaaatagaggcatttccctatatgtaatagattgatatggtataaatagttatgtaatgtatcaatagcgtataaataatatatatctatgcatatatgatataaaatatttctcaactttccaatttagagcttatatattcctcattataaaattaaagtagttggcttataccaatatcgttacaaaagttgttcacatactttttaaaatgagctacttttgttacgaggattatatcagctctaaatcacaagttgaagagtatattaaagatgtatatacattcacatacgttgtttatacaatatttataaattttagtttgatttttttttcaatattgacttactcaaatttcctcttaattgttctaaattttaaatttaaatatgagctcctctcaatattttatatcttttgatatattatttatacggaacaatttatgacattaatggacaagttgtcactctttcctcaatttgcattataattaatactttttgtgttaattttaaggatgttaaggggttaaattaaatatatctcatatatattcttgattgattaaattaagatataataata

SEQ ID NO: 541 - DNA, 13474 bp, Solanum lycopersicum
gactttttctttcaaactagtgtacgttggctgaaaaggtgtaaaaaattacttataaaataagttcaggggggtaataggaccttagtatagtataagtgtgtctctgtgatttcaggcataagttggggggtacttatgcattttccctaaaaaatatattcaacttcaaattcattttttcaccctcaactcccccccccccccccaagaaaatcattttcgaaaagtattttctattcaccaaccaaacatgaaaaaccaagtcaaaaatctacttgttttcgaggaaaacattgtcctgcataccaaacataacctataagaacactccaaagaacttaattagttcgtgagatcgctctactaagaaatatggcattagctacatattttatttataattctcatctaattcgttgttatatagctcttagctatatatatagatataaatatagatataaattgcttgtttttttttggagtgggtggggggaggggcggtgaacgcccaaggataacctgcggctgctatcctttttgccacagtgtctgccctttgggtgagcacttgtgtacattagataaatccccaattgtgtaaaagctggcaaaccacacaggaaatatgaattgcactgtatacaagcctaatgtgttggctctactcaaaacatatggggttgaatttgtagaatatatcgtaccctattcagttgagttaataattttgatggttactcaactattaattgatttcacagaaagtcagtcaacttttattttcaactcaaaagtcactcaactatgatttctttgcacagaatgtcactcaactatgacttctttgtatagaaagtcactcaaactatttaattgtttttcattaaaatttagtcacatgaaatattaattattaaccaaaattttaagacttatatatatatatatatatatatatatatatatatatatatatatatatatatatatctactttttcctcctcatattactctatcagaatgtttctatcaataatttctcccttccataaaattgtaagtacttctttctcccttcaaatacagataataattttttataccttgtacgtatagggatctcatggttttggcaaaactataaacaagaaaatattagcagtataagtagagtgtttttgattaattaattgacatttttatctatttatgcatttgatacatattgaaagtgtttttaaatcaaaatcaattaaaaattgatcagctttatgtatgtttatatgatttataagtatattttgtttgatttaactttttacggttatctaatattccttttctttaggtaatttttatagtatatcattttttttcatcattcacacttcttaaatgcaaaatatacttttgaaatgtatattattaatatgtttataaggatattttaatagaaaaaaaatatttatcaatatctttttatcaaatactaatcgtttattatcatttcaacacttgtatttatatatgtagggttgtggatcaacttttgtcaagcaatccataacaagaagggccactcctgagcaacaggttgattgccattttccctcttttatattgttttagtgtttcatatattcttgagttaaaagtttatgaatttgaaaaacctattataacggaaccgaagtcataaatgaggatccacttaaaattcatgctcacctcaactgattgtccatctaaaaaaatttattatttttattaatataaaattttctatcaattattcaaatgtcttgttcattttctcttttattctcttttttaaattttttattcttaattacaatatccaggactcaaatttgaattgaactcacatgtttatatattctttcaatttgtattatttctatagtgggatgaggctgggataagagaataattatttttattcttttattttgaattttgggtacacacaaaagaaaaatgcaatattcatacatatttgcctaatcatgtttctttgaatgaactaattagttctatatgaatgcatcattatttttctcctttttttctctcttgtttgtcataaattgaaaaaaaattaatggtgaaaaagatccaaatagaaaaaaaactaaagagataagaagtgtggggaggggggggggggctgtagagagtagatgtctaacctcatttaattttaatctactatgaaattcaaaataaagtcaattatgtaagtttatatattgagtaatttcaaattaatttaatggaaaatgacctaaaacgaccttaaacaatgagatttggtacaatattgaagtataatccttagacataaaggtatttttgagtcaaaaggtggacgacaaggatattttaagactgaaaggtgaatggaggatgattttgtaccaattcaaatacttgagaggtattttaggcccttctccaatcaaacaaatgaaagattgtagaatgagagaaacatctaatttcacaattctaacacactctactctcaacaatttgaagattatttcaaatacactttcaagaaaaaggaagaaactcatgttatatcttttaatcaaattattttatttatttttccataataataattgactattagggtgtgcttggtatgaatgaaaatattttccaattcttctatttttggaaaattattccaaatcaacttatttttctcattaagataaacacttttcaaaactctcatcataccttaaattagattctttttttactctaccccatacctccaccatccccatacaaaataaaataacttttttaaatattatgaaaaacatttcacaggagcatgatagtttgatcatgggaccaagagagcaggaagtactcccacctttagtgaatgccataaaaacatcagtcaagaaaaattcagcacctttccattttccaggtcacaaaagaggcatggctgcaccatcttcactagtcgatgttatcggtattggtccatttcttcatgatgcaactgagctcccagagcttgatagatttagttatccaactggacctttattagaagcacaaaaaatggctgctgacctctttggtgcatctcaaacatggttcatagtttgtgggacaacttgtggtattttagcagcaattatgtcaacttgttcacctggtgataccttaatccttgcaagaaactcacatgtttcagccacttcagcaatggtactttgtggtgctttaccaaagtacattcttcctgaatataatcttcaatgggatactgctggaggtgttaccccctcacaggtaattacttgttaaaccttatacaagtttagatgtatgtttgtacacactaaaaattgtaggacataggtatcatattagacaaagttaaagggaacttttagagaaaaactctaacgcacgaaagaaatatgaaagaagtgaagaatttcctaaatgttgcagcctcctaattatagatgtggcgtgcttcacaccgataaccaggactcagcatacacgtctccataaactccctaggattcttgaattctgtgctctgataccaagtttgtcacaccccgagcctacaccctgggtgtgaccgacactcaatgaccattgttggcctcgagtggacctttttcctgactttcttaactcagtggaagacttaaacataaaaaatatagctcgaagatatatataagtacttagcccaaatagaaactcaagtctttgaataatgtttcgaaaaatagtgtaaagacaactgaactactaactgtttacgaaacctctaaaatgactaagatggatgttgggacaaatttcacaacatccaaatgtattaactagaaaacaataaaagatgtcctcttcaatgcaaggagactcaccaactgactctggattgctcaactggactaacggtgcgctagatattgattctcgttatgtgcgcctgcattatgatacgatgcagaccaactggcatcagaacattgaatataaaagtatgccagttggaatgctaaaacaacttatgcttgaaaagagtaagaagcaacacttaccttggatcttctcagctcatgaataacataactcaatattactaactcttttcaaaataaagcaattcaaaagcaagtgaaatataaacaaaaggtgtttaacaacattttgtaaactttgaatgtatacaaagatacaaacaactctaatatgtatgtaaaaatacaaataaactgatgtatatatttatataaatacattaaacttctgtgggagtttctctaaccgaaaactatgacttaagagctatagtgatgatacaacaatctacctcatgctgccaccgcatcctatacccgaccaaaggtattagacctgaactgcctaatggatccagtagtctactatgaaaatggttcatctaaaaagtatgaccctctacacatggtggctacatgattttattgggagatgtgagttatctgaactcgtgctcgtccgtaattcgatgctcaatactactcctaaaatatactggctcttatgttattaaaacttactacttatgttgggagtcttagttaccctgcttgcgtcattaaataagctatactcttttctgaaaactaccccgaaggctttttggaaatctcaatttccattctttttaaaggtgaaaacattttatacttttgtgaaatagaaaagacttcactatactcggaactgaactcaaactcaagtcttgaaacgacattaaattttttttaataaacttatgaaacttgaaatgaacttattgttcttatctttaatatttactcaatttgatctttaagtcttaaaataagtttaaaagtatttgtaaaagacttattgaaaggactctaagaacattctagacgtggctctaaaccttccttgaatatgaggttatggattcaaggttgtaattcatgtttcttgatgatttctatatgattagaagtcatttagagcagttagaatcattaggaagtattaaacactttagagaggcttaattagactgaactacgaaaactagcaaaatatgccaattcatgtatgttttgggcgcatcgcgccaacttcatttgattaaggctcctttcatgtgaactgctagcgcaccgccccaggctctaaggcgtaggtggggtgcgcctcacctggccctgcccaggtgacgcctgacgtattttcatctcgctttcctgaccttaaatcattctgattcgatttcttttttgaaatcaccgtagatctatgtacccaattcatatatactaggatctaactcaaagaacttaagaaacaacactttctacctcaagaaattcataaacttcaactcatgttcaagaacgaaagcaattcaagaacaacattcaggaacattcaaaatccaatctttcagaatgaaatcacgttgaataaaacatgcctggcatgtgggttaatgaacccaacattatggaagactcacataaccttttaggaatcacccccgatgaaaccctcaagttaatttgacgatcttggcgaatcttaccctcttttttcttctcttctcttgtccattctcaaagccctgacgtgaattctcgtttttctaaactaaatgaagtcttgtttttaccccaatttaatacctaaaacaaattaattaaattaggtaacaaaaagacaactttgccattcctaaatccagattggactttccttgatccaatagcccaacttctgaaagccataactcactcatatgatatcaaaatcacgcaaacttggcggcgttaaaatggttattctaaggaatttccaaccatatatttaactactcctaactcatcctgagctaggagttacggtagttttgaaaatgatcgaaactcactttcctaactaggataaattttcgagattttcttattctttccaaaaataagtattttcagtttgtaaacgctttcctatttctttctagttgcgaggtgttacaatatctccccttgggaacattcgtcctcgaatgaaattatccatactagactaagggtagtaatttcaagttcaaacaccaaacaagaaattgctacaataacatgcttacacataactagatagtactgtctacattttctccggatttaaagagatgtggatgtctcttattcatgtcctcttcagcttcccaaaaatattcttcaaaaaattggttcctccaaaggaccttgactgatgctacctcttttgttctcaacttgcaaacttagctatctaagatctcaaccggaatctatttataagataaactatcattgattccaatattttcaattggaattatcaatgaaggatcacccatgcacttcttcggtatagagatgtgaaacaccggatgaacttctgttaactcttgtggtagctccaactcataaactacattgtcaatcgtcttgactatgcgataaggtccaatataccgaggactgagtttccccttcttaccaaaccttataacattttccatgggtgaaacttttaaatacacccaatcatctacttcgaactctaacggcctcctcctaacatcaaggaaggattttgacgacttcatgccgttttcaatctctccgtaatcaccttcaccttctccataacttggtgaattaaatctgttcctatcaaccctgcttcaccaacttcaaaccattgaataggatatttgcatcttctcccataaagagtttcataaggagccatttggatgctagagtggtatattttgtaagcaaactcaatgagaggtaggtaatcatcccaactccctattaaatcgatcacgcatgaccttaattatcttctaatgtctgaattgtacgctctgtttttctatcagtgtgaggattaaagacagtacttaagttcaccgttgaatccaaacctttctgaaagcgtttccaaaattgtgcaataaattatgcgccacaatgtgaaattttggagaccggaactccatgaagtcttaccacctcttgaatatacaatttagcttaatccttctaccgaatgagtagtctttatggcaagaagtgggttgattttgtcattttatcgacaatcacccaaatagaatcattctgcctatgagatctgggtaaacctgtgatgaaatccatattaatcatctcccacttctattttggaagttctatattctgagccaaacatctgggcctttggtgctctattttaacttgttggcaattcgagcacttggcaataaattcagcaatgtcattctccatacagctcctccaatatacttctctctaatcgtagtacatctttgtggaaccaggataaatgaaatatctggagttatgagtttccttcatgatactctcttgaagtccatccatcataggtgcagacaatataccttgatatctcaatgcaccatctcccatttgtttaaaatccaacactctttgctcatgatcattttccttcaattcaagcaaaatgggatcttggttttgcttctctttcacttctggcacttatgatgactcaaccctttctgtcaccattattcctcctttgtggaatccaagagtcggactcgtaagcatgcaagtctatgcacatcttttgctagttatttcttctcttcttcaagatgggcggtactacccataggcaacctgcttaaggcatcggcaaccacattagccatacctggatggtaaagaatactcatgtcataatcctcgggcaattctaaccacctactttgtgtgagattaagctctctctgagtaaacacatattgtaggcttttatgaccagtgaatacataaacatgaacaccatacagatagtgatgccatatcttcaaggcgaaaactacaacagccaaatctaagtcataggttgggtaattcttctcatgaaatttaaactgcctagaggcatactctacccaaacctactctagatgcatgacaatacaccaaaaaaccttgagtaccttctggtaaagtcaaaactactacattagtcaacctctccttcaactgttgaaagattttctcacaagattcagaccatttaaaattcattattttttgagtcaacttcgttaaaggagacgaaaaaacaaaaaaaaccttctacaaatctcttatagtggccagccaagcccaagaaattcctaatattagttggagatgtggatctaggccaattctgtactgcctaagttttctgggtttccactctaatactatcacctaaaaatatataacccaagaaggccacagactcaagcaaaaattcagacttggagaacttggcatacaaactctctatccttcaaggtctggaggactatcttgaggtgactagcataatcttcttcattccttgaatagattagtatgtcaccgattaaaatgataacaaacatatcaaaataaggtttgaagactctattcataaggtccatgaatgccgctagtgcattggtcaacccaaaggacatgaccaacaactcacaatgcccatatctagttctgaaagttgtctttggaatgtcacattccctaacattcaactgatggtagtctaatctgaggtcaatcttggaaaaacaagaagtaccatgacatttatagaaaatatcatcaatctttggaagaggatatttattcttgatggtaaccttgttcaattaacggtaatctatacacattctaagggaaccatctttctttctcacaaacaagaccatcgcgcccttaaggtgagacacttggtcgaataaaacccttatctaacagatctttcaacttttcttcaattcttttaactctgttttagccatccaatatggcaggatagagatagaacgagtatctagaagaatatttataccaaagtctatctctctcaagagggtcttcaacaagattatcttgaaaaacttctgaaaactcttttactactggaactgactaggaggaatctcaacactagagtcattaactcgaactaagtgatagacacaccctttagaaactaacttcctcacctgaaggtacgaaattgaacgacccttaggcactgctgaactgattttccactctaagactggctcattttggaaactgaaacttgactactcgagttatacaatcaactaaggaataacaagttgtaagcaatccagaccaagaatgacatcaaagtctatcatgcctaactcaattaaatcagccatggtacttttgtgattaacgggaaaggggcaaccaggatagactctctctgatagaatggactcaccaacaggtgtaaaaatactaaatggttcactaagttgcttaggaataatatcaaagttcatggcaacatatggagttacaaaagataaactcgctcctgggtctagcaattcatatacagtaaagtcaaagactttaatcataccagtgacaacatctggcgaattatcatgctcttggcggttgttgagagcatacaagcagtttgttcccctgctagtaccaaaagtagctcctcaaggtgcatccttgtctggtggagcatctaatgaagattgggatctatttccccactaccattttcctgcttattctttggacactctctcctgaaattcccgatatgactgcacttgaaacaaccagtggagtcctcacgacaaacatcagagtggttgcacttgaaacatccagtggagtcctcacgacaaacaccagagtggtttctaccacacttggcataggcaggaggcttactacccccttgcaccacactaccctgtgaatattcaggtttaaccatggaattttgacgatagtactcacccttgttcttaggtgcaggtgcactataagagaatggagcgggaccttttggtttttgtcgaaaggatgaccgtttgacattactcttctgcttcccgaactcattccatgtcttagctctcttattcttgaacttctctctgttcattatctttttctttctgtacctgctgcacatagatcatcaacctcgaaatgtccatgtccctaacaagcattactgcccgaaactctattctagaagaacgacataatccagtaacacacaaactcatcctacttctcatgtcatcaacctcgaaatgtccatgtccctaacaacccaacttcaaaaaggcgtaactcactcatacgagatccaaatcgtgcaaactcagcggcgttggaaagattataaggtctttgtaaccatatctggaactactcctaactcatcttgagttaggagttgtggtcgtttgaaaatgatcaaaactcactttcctaacatatacaaattttcctgattttcttattcttttcaaaaataagtattttcagattttaaacttttttctagttttttctagttttgaggtgttacagttctaaggaaatggagaagtatatcactttttctattctaacgaaagggagaagggtgtgactttttcttttttaacgaaagggagatgtacatatctttctaatctaaggaaagacatagtattccttctccttggactaggaagaaatctctataaatagagatttttcaatccctttaaagaagagaagtttttctataaaatacttgtccatccaagtgttaagatatttcagaagtgaacttgaaatcactgtagaacaccacagaactgtcgtctagttcgtggactaccttgtagatttgcttgatggttgtagtttgccgactaacgtgtggattcacttgagggtattttctgaaattaaattcaaaaagttttatatgttataacatgattgtagtttttctagcataaacagcgtgttgtctattattcatataagttgtatgattctggtatgcttctgttgtgcatatagttttccaacatataaacattagatacactcactacaaacaataaattaaactgaaatgagctactaagttattgttgatctgtcgtaaattgcttgtaactaacataatttaatgataattcatcatcaaatcaaattagcaatgaattttgctttaaaaatatgttagatattgtttccatattgttcaggtgaaaatagcaattgaagaactggaacaggaaggcaaaaaggcagcaggagtttttattacatcaccaacttataatggagtatgtagcaatatttctgagatatctcaaatatgtcattctcatggtatccctctaattgtggatgaagcacatgggtctcacttcaaatttcatcctgatatgcctaaaacagctctttctcaaggagcagatcttgtcatacaatctacacacaaagttttgtgctcattttcccaatcatcaatgctacacttatccggggatagcatcgatagagatagagtgcacaaatgtcttcaatctttacataccactagtccaaattgggttttattagcttccttggatgcaactagagatgaattaagtaaaaatccaaacacccttttcagtgaagtaatggaactagtccaacaagtgaaagaactaataaaccacattcctggagtctcacttttggatctctcttgtttctccaacaatttctcttttatggatcctttgaggatgacaattggcgtacaagaacttggcttgtcgggtttagaagcatataacatattgtcaacaagtcatggaattcagccagaacttattggaactcaatctttcacattagcctttagtttaggaacaactaaagaacatactcaaagacttgttagtggattgaagtacttatcaatcaacttctttcaagaagaaagagagattatcaaaatagatcatggaatggatagggtgccatttggagaagtttacatgagttgtacaccaagagaagccttttttgctaagaaaaagaaagtgaattttgaaaaaagtatcggggaagtttgtggagaatttatatgccctttccctccaggtatccccatgctaatcccaggggaaatcatcacaaagagagctatggattatctcattcgagttaaggacaaaggagcttttcttaaaggggctgctgatcctctacttagcactgtggttgtttgtgatttttgaaaaatattatgtttcatctcaacaaagtttaccattcatgctatgtacgtctgcatttgaaggctcttgcttagaatcactatgcatttcattcaaaactagataacttggtttgttcagaaaactaatcgtatcaaaaagtgatcaaataagcgtaatacatagttcgtacgaatcatttttcattaagacatacataaagttgttacaatattccaaagggattaatgaggtgtcacaacttatttattgtgtcaaatggctactgaaggccaataataaaacattattaattttgtttttgacactcaaatccttagttaatctcacttaattactccatcataatctcttattcaagcaaagcttcacataacccaaagttgttttaacttcatttgattttttatcaaatatacaaatctttgtgcatgggaactttcttaggagtttgctacaatgtccatctgtaaactcctctgtgagacaagcttttgtacatgaagagtcggtaaaacataatcctttgaaggtttggctaggggatttgcaaatttactgagcttacacctctacaatcattcacaaatgttagaataagagagacgtaatcgaaataaatattgctcctataatatttagaggaatataaacaaacagattattttagtttttttcatagttgtcaaataactttaaagcatgttataagtcacaatcctttaggtttacttattttatactataattttcaaaagtcaatctttctttcataaacaacttcatgtcaagtcaaactaacttatataaattagaattgagggagtacttaatattttgaccaaaaatagagtaattttacacattatttaagaggactaaatgatgaagacaaaccatgggaaacaaagagtaacattgccaagaccagaaatgccatgaagcaaatcgaacgagccatagtctcttttaatgagtgaaaaagattggaaatgtctttttctaataataagaagaatgtaatttagagttaaaaataaaccagttacacaatgaaggtaatttatagggagtgaaattgtaagaatgggtcaataatatgtgaaccaatggttgttggtaggtcataaactcaattaacatgttcttctttcttttcttttctttttttcttttttctaaaaaaaatggggta

SEQ ID NO: 542 - DNA, 4044 bp, Solanum lycopersicum; identical to SEQ ID NO: 496

SEQ ID NO: 543 - DNA, 5719 bp, Solanum lycopersicum
aataaaaaggaaaaattcacttttcacttttgagctagcatttaagtatatatattttatctaatataataatttatggctaaacgtctacttagcactgcacctaaaatgatgaattagttttcctgtgaaaattaaatagacatgttgaaattaatcctattaaggcgaaatcttaggttatagagttgggcaaacataggaactttttgcaaccgtttggtcatagattttgaaatattttggtaactattaattaagtgaaattttatcacgtgtgttatcatagtattggaaaatatagttcatatttttttaaaaaatattatttacgccataagttttaaaaattatcacaactaatcaaaagtttgtattacgtagcacatgattttgttaccttaagttttttttcatcacacgactttgttatcttgagtcgattattcatcatcttcattaataatcatagcatcatcatttttatatttactaaatattctaacactattttgatggtcacgtaaaaaaaaaaattacgtagaacaatatgtgtttttataaaagttaaaagcttagtgtagattttaataaattattataagttccgaaataatgaaacttggtccacatattagtaatatttgagaatttgggttaattgccaaatatttacctaacaataacaaattatatgaacaaatattatttgttgattcttttcttaattttacaagttcttaatttcttgttattatacttgtataattctttttgttattattgtttttttttatgagcatttataaagtgacgattttatcttgttccattaaattattagaatagtcatatatttatattataagtattttcttattaattaaactaaaaccaaagcattagatattaaggaccaaaatcaattaataattaataattttttgagctaatatatttagaaattaaaaattgataaatcaaattgataatatttgatttggtgggtgtgaagaaagagaaacccatgggcggtagtgggttttagggtaatattgtttacgtctcctttcccactttcactgtatatattgctgccaactttgcctaacactgcctatatactactagttggctcccaataaatccaaaaggccaaactttttcttgtgaactccgcttaattgcagattcttgattcattgtcagccaaccccacttcttatattggtaagatttctcatttttctgttacccctttgagagattcttgagttttgagttgtgagattctgcttgtttggttcatgtacgtgttgttttctgagtttcgtgatttggggttgtggtgtttttgctagtagttgtttaaatctcttgtttggttagtttctgtgttaaaagattgaatctttaagaaaagctgggcttttcgtgttcttgattcattatcagccaaccccacttcttatattggtaaggattctcgtttttttgttaccttttaagagattcttgagttatagttgtgatattctgcttgtttgattcatgttcatgttgttttctgagttttatgaattgggttgtggtgtttttgctattagttgtttaaatctcttgtttggtgaaattctgtgttaaaagattgaatctttaagaaaagctgtgattttcctgttagttccatgttcttgattcattatcagccaaccccacttcttatattggtaaaattaatcattttttctcttacccgtttaaagagattttttgggtttttagttgtgagattctgcttgtttggttcatgtacatgttgttttttgtgttttatgaattgtgtttttgatgtttttgctattggttgttgagatctcttatttggtgaaaagattgagtctttaagaaaagctggattttgaaactttgaatcttgttttttatttcttgtgagctttgaattcaaagtttcaaagtcaaaaagcataacttttgtagatggaaaatgacctttgagcttactttttgttggatactttgttggtttgcataggtagtgaaagagattgttttgtccttttggcaattcttgtattctcttttttggtttgtaaagagaattaacttgtttaattcatgctcatgttgttttctcaaatgtgtttgggattttgaaattttcctgttaaatgttgagatctctctttgtttgtccatcatttcgtgaaattctgtgttaaaaaatgaatctttgataaaattggattttgggtacttcaaacttttatgaatactttgaattttgctgttctttttaatcttgtgagcttgaattctgtttatttctttgcaaagtaatgaaatgagtagtagctgtagtttgtttttcagctttgtcatagtatgaatgcagaaacattttggtaaaaagctaacttgttacatgaaagtactctggctttgtgtcatggtttgtattatataactataatcaattcaaaaaatcttagctctatactcgcataatgcgattttgtgcttttgcttttatgttgttgagtctagtcctgaaattagattggtaacaagacaaaaggggactttgtgatagtgtatgtgaattgcaatggcctctttatgtaatttgatttagtgaaggtagatgaagggtatttatccatttaatttgttgggataattcatagaggatgattaaacaatctttttgatatataggaatttactataaatctaattttgagcaaatgtagttctctaaaactggatgaatctataaccagacttttggaacatctagaagaagaattaaacaagccttggttaaattccctgaagtaggaaatcaagactttttcatgcaagaacacattctttagtcggagaggatattgatattgtgattatgcaatttaattgttcatatgtgtgtaacgtgcattttagcccttcattcattgtcattatccttgaaaccgtaaaaggaactaggataccaattagagttgcagaatcatacattataccatgcttctagattttagtttcacaacatggagtttcgagtgaagaacataaagccgctcgcttgcttcttctcataatgctccagatattcaaagccttgtcttttaagaaatgcacttgtcagaatttcagttctttttcatataccacagagcatatattatcaaaatgtcattactaattagtcttgaaattgtaaaaggaaaacaccgtataacactatcatagattgctatgccattattcttcataacatggagcttcgagtgaagaacatgaagccactcgcttgcttcttctcataatgctccagatattcaaagccttgtctttaaagaaatgaactttcagcttttcatttctttttcatctaccacacggcatatatcatcccaaatgtcagattatttcttgttcatttgtgtgtaatgtgcattttaacccttccattcatagcctaccgtcaacattgtaaaaggaacaaggataacacttaattggtgaatcatagattactataccactagattttgtcttcacaatatggagcttcgagtgaagaacaggaagccacttgcttgttcttctcataatgctccagatatttgaagccttgtcttttaagaaatggactaccagattttcatttctttttcatctaccacatggcatatatttttcaaatagtcatatttgttccactcccgtgttgggtttctaccacgttcttctttgctgcttggccgacatcaatagttttttttttgggtagaattgggttaagatatagctccaggtactcatatgtatatgcatgtcattaatgtgaaagaattttggtatattagaacacttgaaatggacttgttgacttctgtcgataaacaaatgaaagctggaggttgatttgattctttttactttttcactagatatgtcaaacacttaagcttcatacatgtaccataattgtattgctagatattcttcttgaacatatccgtctttgttacttctgtatttcatgatcacttttaaatttgatcaggtaaaacatgtcgaccgtaaggcttccttccacttgcatgttcaaagctgcacctctgagtgaaagaaagagtgcatttgttaaaatgccattctcagtgggctctgtaaggaacatctccaaatcctttggcttgaaagctgactctagctttagagtatcagcgaacgtgtacaaggtcaaattggtttgtccagacggtactgaacacgagtttgaagcaccttccgatacctacatcctcgatgcagctgagaatgctggagtcgatctcccttattcttgcagggctggtgcttgctcaacttgtgctgggaagatagagtcgggtactgttgatcaatctgacggatcttttctggacgacaaccaaataaaggagggatatttgctcacttgtgtttcttacccaaactctgattgtgtgatccacactcacaaggagggtgatctttactagttaaatcctatgtcaaagcaaaggttaaaacagttagatattgcttttttccccatctagtgtcaaaactaaaggttcaatcatgaacttgttttgtttcataaattgctttttatgtaatgaagtgtttttcttatatatgatggtttatattttccctaaatccttgatgtttcatttccatatgtgctatttttgcattgaggcatgataatagtattagatatgaaaatgatgattcagaagaatcaagttttatgaatttatacacacttactaagaatgcttttttggtaaaatgacagaaatttcacatttaaattttcttattatcaatccccggctagttttacaaattcctagaatccctcattttcacgcatcatcaaattaatgtatctcgtgcatcatattagtatatcatgtgtaaaatgtacgtgagatgagcgtatagaagtatgtgatttttgtcatttgccttaatttttttaatttttatgggccactatgttgggcttcatggtttcttctgaaactgacccatatatcaacattgaacttttctagttaaccatttatcttctacttctatggacaaacaagaaaaagtttccttcactcatatatatgaaacatttgtatataatttagccaaacactatacgtggggtaggtaggaacgaacgaacacacgcacgcagtgctgcagagagtggcgtagacagaatttccactagggagttcaaattatgaagatgtgaacacatgaagaaactaaagggtttaacatgtatacatataaactaagtataaccatataaaaacagtataagttcgtcgaaaggggataggatgacctccttcggccctctacttagctctgctcttttttctgtgaggtggaagaacttacatgacataagtcatttcttgattttcgatgaacttatatttctaacaaaaatagtttctaaacattttgacgaaccgtacagtatttttctccataccaaacataccctatatgttcaagatccccttggcttttcaaaaagcctaaaggttatattttaaagtatggaaaacaagaacttatacttactagaggctccaaaaagattgtattgtcaaaaaactttttgttcaaagggacaagaacatga

SEQ ID NO: 544 - DNA, 2620 bp, Solanum lycopersicum
atgatgaaaaaatatatcttaaaatgttaatcaaagtttttatagtttgactctaaaaataaaaataatgacaaataataatggacagggggagtatctaatttttttaaaaaatgaaatgttactgaatgatgtactaatttttccatgttggataattttggtagtaggttgtccttctcgatttgttaaaatgttaatcaaagttatttgaaaaagtgtacattctctatgtcagtgaacaaaaatatattctataataaaatatttgtaaaaataaaattatattagttattttaagtttctcactctctttaagagagtgtacacactcactttgtcaggtggataataatgtaataatatcagttcaagattatttattaggggcaataagacgtctgcatagttaagatgtctgcatagttaatgtgtcttattgaaaaatcggtgtaagttcaggcattactttatgtcttttctctaatatatttaagacaagtagtatattagagaaaagacataaagtgacacctcaacttatataacagtaagagtatatatcaatactggaaaattgaatttagcgagagaaaatttttgtagttaaacaacaaatccgttaaatccacttagcgactgatttctattagcaacgaacaaaatagcaacaagtagcgacaactgttactaaatgcaataattttaaatagtttataagttatttgtataacgataagaatatatatgagccccttggtatcaactctaaataaacaaattaacatatatataacatcattttttatttgaaaaaattaagtgatgattttcgctttcaactatttttccaaaaacttcattttaaacatgataaaatactagccacaaaaaaaaataaaaataaaataaaataaaatactagccacataatgtttgacacgtggaagataaaccaaaccttacccttctctaaaagcacactatatccacaagcccctcctttattcattcctcctatctccaaaccaaaccaaagatttcaaagaagtaaaaaaaaaaaaatggctagtattcctagtaccatagttaacactagtttcttgccaagaagaagtgttgttactagccttaaatccataccaaatgttggtgaatctctctttggtcttaaaagtggtagaagtggaaggattacttgcatggctacatacaaagtgaagcttattacaccagaaggaccttttgaatttgattgtcctgatgatgtcagcattcttgatcgggcggaggaaacggggctagatcttccttattcatgtagggctggtgcttgctcatcttgtgctggaaaggttactgctggaagtgttgatcagtctgataacagttttcttgatgatgaccaaatagatgaaggatttgtgctcacttgtgttgcttatccaaagtctaatgttaccattcagactcacaaggaggaggaccttgttggctaactagtattttacttcttttcttatcaataattaaattaggtgctatgtacctcttttatataagtcaatgatgacttgtaccataatgatttatggaagaattaataattttctatttttatttaactcgtctcatattcacttcaaaaatcagaattttcgttaaggagtgtacggtaataaaagattaattataaggataattggacatgacctcaagaaattttcactattagtgtcccctaattcaggaattataacaaacaaagcaaaaaacagataacacatatgttttaattgaaaacaatgcacgaagaataaatggtacattctgttttgttacattacagaatatcaccattaataaaatatcaaagagtaatactttattcccatagccttgtggctattgaaaattaaatttaagtacaaaagtcaacaagttttagatgtgtcagcactacattttttccactccactcttccctcatggttttatgtagtagtcgatatgtcaacattgtgaaagttgtctaacataatttcataatcaaagtttgttaggaaattaaataaaaaaaaatagtctttcaaattcattaaattagaatttacaatattacagaggtttggttagaggatgtcagtaaaaaaaaatgatcattagcaacaactaattcttaattgccgctaaataagtatttttagcggcaattgtcactctttttatatgttcctaaaacctttagcgacattggttctaatgacacttaactaatgccggtaaagattttaacactcttttaatgtcaatatttaatgccgctaaaaattatttttattatagtgtgtgatgagaattataatacttaattcctcttataattggcctccaccacatctttctagtggttcaatttggattggttattgattaaaaccaaaaccaaaccaattcatttggtttttcaaatttctaaaaccaaaaccaaatgaataaaaattataaccatcggtttggttcagtttttctggtttattaggtttgaaagtaatatttttttaaggacgtacgtatctcgatagacacaaacaccaagtacatgaacaatctacagaaa

SEQ ID NO: 545 - DNA, 4089 bp, Solanum lycopersicum
attaagtaaatctttatcttatttatctttgaaaaaaattcaattacttttcattcattgtcctttttgctaacaagtagcaaatgggtaaaatgacaggatgttgccagtagtaaaagttgttggtcttatcaacaacaacaaggtcataagaaacttgctaacaaattaaaccaagtgttaacaataaagggtaccatttaataaaataaatactagtacttctcatctacttatcctgccctttgagttattatacttttgtcagtacaatataattgatctggttggcttccacttactactccaatcatataatagagcaaaagagtgtataggccataccaaattcttgaatcattcttgcaaactttatctctacttcttcaaacccccacccccacacttctttcaataataacatttcagataatttacgtgcatcttgattattttatttaaatatgtatttttttttgttgctcgacatgttctcattaagaaattcaaattatatatatataataagcagattaagaagtaaaggagatacggttacgaataattttgatcttattgataaaatgtaatttttcaattcaaataaaccccctgcgtccctagcttctacctaacaatagcagaaatattgagtaactttatccattaagactataacaaattgaactattgcaatttatatcgtaattttatttatttcattgaccactaaatcacgtctttaactgactctattttttattattcctaacaaacaccaaaaaattctaaagcatccaataccaaaacaaaaaaggctccagctcttatgtatgctaagctggcaccagttgttgcccatgcatccccccccccccctccaaaacccccacccacccacccaaaaactcaagaagttcacaagatttttgctcttttctttatagctataagctccttctactcactataaatacttgctccctttaaatctcatttcacacacaagcaaaaaatcatatattattcaaagttcaagtaaaaaattttaactacaaatggggtcttttacccattatgggttcttgatgttagcacttttatttagttcttgcatggttacttatggtggaaatttttatcaagaatttgacttcacttggggtggcaatagagccaagattttcaatggaggtcaacttttatctttatctttagacaaagtttctggctctggttttcaatcaaaaaaagaacatctctttggaagaattgatatgcaaatcaaactcgttgctggaaactctgctggcactgtcacaacatattacgtaagtacgattaaatttcacatattgatgctgaacttaaactattataacattatagaatgtttgtgaaagctacttgtagtccaattatttgtctttcaagtaagggcacttcaaaatatttgcaattttgagaaattttttggaagtcatgtcatatttatgaagttattatattattcacaagcaacttgtttaattttacatgtagaaataaccacaaatatgtaacaacttggttggtactcatgtgacatattttttttatatggccaagagcttttctattttggatgttataagcaactttttatgtgtgataataatgacttcttgattccctattccttttccttttattttgattcctcaaagcatattacattgtcacactttacaagttgtcaacttctttttctataatagaattatacccatcttaatttattctaagttttacttgtcaaaacataaaaaatattgacataatcagattactgataacatatagctataagtacacttttgaaactatgctaatactgtcatacttatatttattgcttgaacctttctaaaatactattatacttatatttgttactttttaaaaagttcgagcaacataattgatgactagagtttaatgttacttcaatttggaaattaataaaatctaagtagcatttttactaattttttttttaattgcagttatcttctcaaggacccactcatgatgaaattgactttgagttcttgggaaatgttactggtgaaccttatattctacacacaaatatttatgcccaaggcaagggtaacaaagagcaacaattttacctttggtttgaccctacaaagaacttccacacctactccatcatttggaaaccccaacacatcatgtaagcaaataccttaacattatatataagtattaaaaacctctattatatgcttcggagaaataagaaaattaatctcacgtatgatcactgaattttattcacttaactatatatacttacatgtctaaacactattcttctttttttcaagtatcaatagtttcatgtctgaacgcataactatttgttctctattgcgttaaagtaactgaactcgaatacaaaatttcctatcatagtgacatttattcatttataatttaatttatttcagatttttggtggacaacacaccaataagagtatacaaaaatgctgaatcagttggtgtaccatttccaaagaatcagcccatgaggatttactcaagcctttggaatgctgatgattgggccacaagaggaggcctagtaaaaactgattgggcccaagccccattcacagcctactatagaaactacatggcccaaagctttagcccatcacaattttctgatcaaaaatggcaaaatcaagaacttgattctaatggcagaagaagacttagatgggttcaaaagaatttcatgatttataattattgtactgatattaagaggtttcctcaaggttttcctccagaatgtagaagattttgagagggttatgtagttttttttttgtttttttttttttgggtgaaattctttcatgtgtttgtggttttattttgatagattgttagccaactaaaataaattaatatgttttttctttgttttattttgtatgttatttgaaggtagctagtagtttattttgtatctattttatttgatatcctttttagtatttttaatattagtaattctttcttattttgattcgaacaaattcagtataatctatccatttgacgtctttaataactaacaaaggaaaataacattgaaacataaagctaagatcaattttattgatagtgtatgctcagattttattccaaccttagaagttgggaggtagaacagttattttcgatagacccttgatcggctcaaggacacgtatattaaagcagctcgggatttattctaaagttattataattacaattattttaaactactggctaactaatgatctagttaattaatcatttgataaaaccacgaatattagtattcctaatagaaaaataaccctttttcctcaccaatctttgccatgaaagctattctcctccatattgattatcttagatgttcctaaaagctcaactcaaccactggcccgcttgcccacctcgattaattccatcggaataccaacttttctcccggttttgagtaacaccacccaccaacgcttggatagatgaaaagacatcacctattggttttcatttgtgttagaacttgaattcaaaatctcatgactctcttcgacttcattgactattaagccagaccctttaatgataaacattcatactttagttggactagttagcatataatccagagaatgtagggacaattactcgtgtgttttctgtatatatctaggtcttaataatagccatggcaacaaagatgatacataaacgatataatataagttgaaactcaacaaacataaatttttaaggcatggttgtggaaagataattttgcaagtataatgtaatctctttgcagtaagatgacaaaagaagaaaataatctcatttctgaaggagaatcaagagttatagcttcaaccatgaaaatatttttctggacaatgtcatctatctacaagtcaaatttgatgacacagagaaggaactacgctaagtgatgcttctttcggctacgttttgtccc

SEQ ID NO: 546 - DNA, 4562 bp, Solanum lycopersicum
atatttaaataaaaataataataaataaattgtgatttatctcttacggaaataatatcacatttgtactttgcaattagtataaggagtaaagtatatttgttgaaactttttatttagtctgataattttatttgttgactttaggtctctttccatttttttttccttttctttttttgtggttattatattttcttccacaatttatagcttttgttcaacaaagcaaacatttaaaataaaaataaaaaaacggaagaaaaaaaatactggattaaattatactcttatgtattatttcaatcgaaaacaggtaaattaataataagaaacggaggactagtatctcacttcatagaaccagacacataaacagatggtctagtaagataatgagtaacctgattcgctgatttctcaacagacgacaaagagtgaaaatgtaacccttgataagagttttataataaaaaattaaagaatcaaaataagagtaattcaccaaattttcttctagacattgtttcacgagtagagtatcagtttcctcaaccaacctcattctaatgaaccgttccttttgccaactaagagtctcaaacacccctatgctcttggccaacaacgagctagccacatggctaagaaataaagttttcccaacaagaaattgattcaagtgatcatgttgcgtcatgtcaatccccatcaaactaatattagtgttacatttaattatgtcataattaatacattttttaaaatattaattaagcaatatattgatacacatgcaaaacacgtacactaaattaatattattaaaaacaagaacttttgactaggaccatatatacttgatgtccaagcacaccaccaaacccatggtccctcatatattatattatgcttatttttttaaataaaaaggaccatacttggtctccaagaaaaattgtcactatattatgttgatactaaactaaaatctaaatctatctttaccattacaaaaatttgtgtttcttatctttttattaccttttttagacatctttaattgaagtacttgtttgttctctcttaaggatcggttcgaaagtttaagtttgagttctctgtgatctcaatcaacagatttatttgtttttgctcttctaaaaagcagatttcaatactgatgacaacctccaacacacaacaaagctatgacaaaacaagtgaactaaaagcctttgatgacacaaaagcaggtgtcaaaggacttattgatagtggaattactaaagtacctcaaatattcattcatccagaggccttagaaaataaaaccacaaatcccaaaaatacacatttcattttccctttaatagacctccaaaacatcagcattaacaacaaagagatagtgaaacaaattcaagaagcatcagagacatggggtttctttcaagttatcaatcatggtatccccgtccccgtcctagacgaaatgttgcgtggggcacgacgttttcacgatcaagatatcgacgttaaaaagccatactatagtcgagatattgcaaggaaagttatgtacaattgcaattttgatctatttagtgagaaatctcttgcagcaaattggagagactcactttactctgtcatggctcctaatcctgctactcccgaggaaatccccgagacatgcaggtactttttctatgaaatttaacttatatataccgacaatcaaaaaaatatattatactattaggtaccatgaatgctactaatatacctttttcttgaaaaaaaaacattgaccataatgataaattaaaaaataagtcaatcattagtactttagtgcttttatttaacaaccattgccttctcataacatgtctaatatgtcatgtcaattatataatgaacaatacgttacagccattagtattatttatattattattaattaaaaatgtattataataatatttcattaaattgattttcatgttatggtgttacattatattatacattttcttgatatcatttcattataccagtcaaataacatctagacaaacgacatgtttatacagagatttggtagtagaacttcaaatttaacaactacttttttcattgttgtagggaaatcacaattgagtactcaaattatgtgatgaatttgggatacacattgcttgaattattttcagaaggacttggtttaaaaccaaaccatctcaaagaaatgggatgtgctgagggactaggcattttgtgcaattactaccctaaatgtccacaaccagaaattgcaattggcacaagtagacatgctgataatgattttttcacagtgcttttgcaagatgatattggtggacttcaagttcttcacaagaatcaatgggttgatgttcctcctactcatggagctttagttgtcaatattggtgacattcttcaggtaaagtgttctttttactcgtattggatctttacacgaatagccagatagatataacgtatattttttctagtcagtatacgtaaggtaacactcattatacatggtaatacacatattatatatagattatacataaatacacccttcaacttaaccttattttatatttatgccctccaactttgagtgtgcacaagtaagcacttaaacttgtataaagttgaacaaatagacacacgagtcctacgtgtcacaatacacgtagaacaccacgtaagacacaaattttcatgttaggtgtcatgtaggacgtttgtgtctattttgtttaattttatacaagtttaagtgtctacttgtgcactcccaaagttgaagggcataaatgtgaaatgaggacatatttatgcagtatgtctatatattatatatcgaccgactattttgagttaaattagttgggtggacgactatctaggataacttatttagcattttctcgacgttaccgaatgttgtttgacctatagacttaattatgttatttttttcgtagtaatttcggtataatgaaccaaaaattgagtgatcatcgatgaaatttttagaataaatataaatatctcttttaatgagtaagttattataaacttataatgttttatctcatttttgacttttcagcttatatcgaatgacaaatataagagcgtagttcacagagtattggcaaatacaattggtccaagaatatcaatagcaagtttcttcagcacagggccattttcaacttctagaatttatggaccaattgaggaattattatcaaaagataatcctccaaagtatagatcaacaacaatgaaggacttctttgaatattctaataaaaaaggacttgatggcaattctaatttgtctcactacaaaataatatgaattttgatatgttggagtaaaaataatgtttttttttgtttaaccaaaaaaaaaaagattatctaccttaagaataaaaagatgttgcatttgtacttttgtatttgtttttgtttgatataagaaataagaatgtgagattatttattacgtatttattgcaattttataattttaatattattttcaacgtatgataataatgagagaaataaaaaaatgcaatattaaagttttccgagaattacttatttatattattattactttcttctaaacacgctttgaacggattatattttctttctattaattaatgagtgaaatactactaagaaaatatcccatggtccctctacaattataaagaaaactccaaatgtcacttttaaaaaaatttctaatttttttaataaaataactccacttaacttaaacaaaataaacttttaaacatttatcatagaatatatagctaactttagttatatggatccttaaattcgtaaaaaagaaattgaacaagtaaatagagacggagaaaatattatatatttatttatataaaagtatattgatattacaattatctcgtaaagttaaatttgatcttttttctttatttataacggttaaaatgttcttttactaacattttctcaagattcaaagtcgaaatatctatgtaattttataaactcgattttttttaaaaaaaacaattaattaattgctggaatattcctattcctttcctcttctccacacgtattttaaaccaattctcctccataaccaaaaactccataaaagctcatctttcttcatatttttttttttcaattctcaatttattctctctccgatctaacaatctgttcattcggaattcgcagaaacgaatttcgttcgattctgatcaggagagagaattttttcaaaatttttttcgatttttttggactatttttgcactttttgttcatctgggttgatttggaatacgcatgtgtgtattgatcaagctgggtttttcttcaatttcaaatctgtttataacttgttttttgatatttattcttcatttttcacctcggatttttgcattttctgattctgataattgcagtattaagtcattgatact

SEQ ID NO: 547 - DNA, 2199 bp, Solanum lycopersicum
ccaaaaaagatcacttttgacaatcttaaggaccaaaattgctcttatcatacataagggagtctattgaaactactaaaaagataaggaagcctttttgtcatttctctataatttcctttgaattttcttcatacatgctaaacaaaattacacaatgtttaattatatatacactatttaaaggaccaaaagtaattaattctaaaaagttttaaggaccaaaatcacttagcaaaatacacaagagactattttgaacttactatcaaagataagagaccatttttatcatttcctctactaataatttcctttgaattttcttcacacatacttagcaaaattccacaatttttacttataaatacactacttatctcacgtttataatcacaataacttagatttattttctctccactaaacctaaagaaaaatggggttgttcaacatctcattgttactcacttgtctcatggtattagccatatttcactcttgtgaggcccaaaattcaccccaagactatcttgcggttcataacgatgcccgtgcccaagtcggagtcgggcctatgtcttgggatgccaacttggcatcccgagcacaaaactatgccaactcaagagctggtgattgtaacttgattcattctggtgctggggagaatcttgccaagggtggtggtgacttcacggggagggcagccgtgcaattgtgggtgtccgagaggccaagctataactacgctaccaaccaatgtgttggtggaaaaaagtgtagacattatactcaagtagtctggcgcaactcagtccgactaggttgtggtcgggcacgttgcaacaacggatggtggttcatttcttgcaactatgatcctgtaggcaactggatcggacaacgtccttactaaaatgatgtatacttatgacatgttgctagtattaaataaaattctcatatgagacgtcgagaagttaaaatttaagtttgacatatgaatcaagtcaaactcctatctaaaatattaagggattaaatattgaacatctataattattattatttcccttttgatgttgctaatatgaataattccacataccatatgttcataatgggcttaagttgattattaagtactgcatcttcttgtttccataaaacattaatatacataaaattttaattaagcatggcatatattaattaggcacatcaagcacttatctaaacacgtaactatttattcataaattcagtttcaaccattcaaaatatttgttctattttaagtgcccatcaaaaaaaaattcaatcattacccaattttttttcaatgactaacaaatactcaagtcttccatattctctcatacaataatggcctaaaactatattttcataaaatattttataggtgaaaattgaatttcatcctttcttgacctattgtcttagatttgaataccagaaataaaaacaaatattgctatttattgaaaaaatttacgtagcatgaaattaaataaattggcacatatttaaaatatctcgtcaggaaaaaaaaattgtacccctaacaaacgtttaaatttaataattttcacaaatgttactaaatttaacaatgagagtttgataaatatctaatcgtgaacagaaagtgttcactttcgaaaaacaaagaggaccaaaagtgatctattttgacaaatttaaggatcaaaattgatccaatcatacattagggactattttgaatctactataaaaatgataaggaaccatttttttgttttttcattttctctattaagtttctttgaattttcttcacacatgctaaacaaaattccacatatttacttatatatatactatacttatctcacattcataatcacaataatttagatttcttttctctctactactcctatagcaaaatggggttgtttaacatctcatttttgctcattagtctcatggtattaaccatatttcacacttgtgattcccaaaattcaccccaagactattttgcggttcacaacgatgcctgcgcccaagttggagttgggccaatgtcttaggatgcttcacaacgatgcccgcgcccaagttggaattgggccaatgtcttaggatgctggcttggcatctcgagcacaaaattatgccaactcaaga

SEQ ID NO: 548 - DNA, 3350 bp, Solanum lycopersicum; identical to SEQ ID NO: 400

SEQ ID NO: 549 - DNA, 2574 bp, Solanum lycopersicum
tttaattttttaatcaaatataaaatatatatttttttgaagaaataaaatttttataatttattgatagaatgattaaattcatatgcatatttagatagtgaaaataaacaatattaattattcattgttcagatctaaagaccacatcttaatatatagatctgtattttttatctagacatcaacatctgaatgtgcatcgtaattctcaggtgccttaattttaatgaaaaacaaatgagggcttagttgacttccgaaatttaacaagatactataaatcacaataattaacaattgaaaatatttaaaagtcatacaagaaatttgcttgactctctaattccatatgtatcgcttatgttggaatagaaaggagtaacatataatatgattttacaatacctaaaaaatattataaatcacaataaatcaacaactacaaatatttaagatcatataagaaatttggttagcactcctaatttcatctatgccatataattgaaacagaaaaaataacatatattatatgaatatgacgtaagaagtactacaattcataataaactaacaacttaaaatgtatattttttttaaaaaaaaaaacacatacaaaattttaatactctccaaatgtcatgtaaattaaaacaaaaaaataatatatatttggtctgtggtgacatatccttaatttcctatttatcaagaagaatatccttttttcttaaaaattccttttaaattgtggttgagaggacaaaattaaagccacaagccattttgagaatgaagggctgaaattgaagcttgattttgagtgagcgtgacattcacaaaatgactggtgaatcccgtctatgttgataaactgataatgctaaccacagcatgttgacacgtggaagataaaccttctccaaaacacactatatccccaagcccttgccattgttcaaatccccatttcacaattgagagcaaagaaaagaaaagaaaagaaaagaattgtaaaaaatggctagtatttctggtacaatgattagcacttctttccttccaagaaagccagctgtgactagcctcaaagccatatcaaatgttggtgaagctttgtttggtcttaaatctggtagaaatgggaggattacttgcatggccagttacaaagtgaagcttattacaccagaaggacctattgaatttgaatgcccagatgatgtttacattcttgaccaagctgaggaagaaggacatgaccttccttactcatgcagggctggttcttgctcatcttgtgctggaaaagttactgctggaagtgttgatcagtctgatggaaacttccttgatgaggaccaagaagctgctggatttgtgcttacttgtgttgcttacccaaagggtgatgttaccattgagactcacaaggaggaggagcttactgcttaaattacaaccatttccattttaataaaaaacaacacttcattttgtttcatgagcatttacttttcacattttccctctattgttatcacaaaagttgctatctagttatttgtgacaacccttttatctccttacataatgatgcaactgtttattaattaattttcatctatattgctaaattggatacaattttcatgctttcccatatatataagattcatccatgttcatcagactgttactttacaaattgatgtatattcgttttctgagttacacaatagaagcttaatcatagacaagtgatgagatagcaaaggcaacaataaaattcttatgtaaaaagggcttatccctctgcagctagtgtaacgtatggggagggtgcgcgtacaatgtacagaataaatactgtgtagcatgagaaaaaaaattacgtcttctggaacaattcgaagagagtttctatcttgtctgcttcatcatccacaatctcctctgcatcagtgaccagaacttcactgtttctgaaggataattcatgacctggttggtttgtagtttcaacaatgcaatcttcttggtgatcattagacagaaccttctcatctaggtggttaaatgagcctctagaggaacatggagataaagttactgatgccactgttgctatctcatccccctcatcaattgttgatccaagggaacatgttgatcttgtagttatagatcgtagagcatcgtgtttcgatctgtcctttactcttttacaccaactgtggagtgagtctcgaacactttcagctacgagagcctttccacaccgtgaacccatctgtaaaccaaaaaattattggaaagctgatatctgtctctatgtgactagttcaattggcatatcaatacttactatgcattatgctagagatataaacaagaaagaaggatcacctgcgagataatcacatttaaaggaacagtactgtggctacaccagaactgcacaagaaccctgtacatagagtgagtgccaaattggtccatttataaataaatataagactaattatataaaatattatgcatctaaaaaataatgtagcatctgaaaaa

SEQ ID NO: 550 - DNA, 7325 bp, Solanum lycopersicum
ttagatttttttttttaattttgaagattattttgtttaagaaattagacgggttattctgatttaaattttaaaattaaattatttttatttaattgaagataataataaaaattagtatataataaaaattagtattaaaataaggatgatagttcataattttttttcatagatggtgaaataatttatctaaattataatcctaatttattataaacctataatattttagttttaaatttgtaataaaaattatgaaaacctcccaaatcaatcgaactgaaacaaatctaacaaattatctatcatttcgaggtatttttttaccacacaaaaagtaaaataacgtaaaaaaaattgaattgagttgaataacttttttagagttatgtgaatcttcattttcataatttttattaaatttaatacacttaattgtaaaatatcaataaaagctaaaattattcacttttaataaattcaaaatacacacaaataattaaatatataatcaaaagattatttaacatagtatataattaaatttattattaatgatgattatgatcgtaaagttttctttttttttcctcctccattttagatttacttattatttcataatttttttaattataactttatcttatctccattttttataggtataattttaaattatttatgtgtgatatttatataatgataaaaatcattacttcattaaaattatataatacaatataatataaaaagataacacaacaactattcaaatagaatacaaagaggattataatacgaaaacacaaatctaaattaattaaattttaatacgattactttgtctttatgtatcaaccacttccccttgacttcaaagaataaaaataggcatacggcgtaagatagcacgaagggatacttttaatctcagccgtccacgtcatatctctatagatattttctgtattatataatatccatggcagaagctaaactttactacattattgcaaatcccgataataatggttcacgtcgccggagttttcatcctcgtcggaatcgccgtgcttgccgccgtcgaaggacgtaatgttttgaaacttccgtcggaagcttccagattcttcgatgacgcagatgactctgttggaaccagatgggccgtccttctcgccggatcaaatggttattggaattatagacatcaggtagttatttcgtatattatacgtattagatatgctattgtttgaattttttgaattagtgtgagttcgtgtttttcttccgatctagttcgttttgtttttttgtaatatctagaaattgttttttttttgaatagtaggtattagatgattgctgtttgtggtgaaaatatgaaggaaagttttcagtaaatgtatgttgatgttatgtttaagagatgaatggaaaatttgaggtgcttgtgttatgtattctttggttggttgaaggacaaagtgagctagacaacactgtacttggataattgtgttttaatagatgattgctgtttttagtgaaaatacgaagggaatttcagtaaatgtatgttagatgttatgtttaagagataaatgaaaattgagctgattgcataatgtattgtttgtttggttgaatgatatattgagctaggatacattgcacttggatgttgtctttgttgctgtttttggtgaaaataggaaggcaaattttcagttaatctatgttgatgttatgtttaagagataaatgaacattaagctgcttggataatgtattctttgtttggttgaatgagttagtgaagtaggaaacactgcagttggataattgtatttattgctgtttttggtgaaatgaaggaggaaaattttcagtaaatctatgttgatgttatgtttaagagataaaatgaaaattgagctgcttgcataatttattctttgtttggatgaatgagctagtgagctagaaaatactgcacttggatgatttcgtaaagggttatagtgtacttttattggaatttggactttggttatgtagtacttgttagaattaaaggttataaacaaagactttcatcattattagctgctgtttgtccatagattatgaagttgaaacttgaatctttgagcttttggaatttgaagttgtgtttggacatgcattttacttggaaaaaaattgaaatttgtgaggggaagtcccaaacccgccaaaactggtctgagccaattcttgggaacttgaaaataatattgatgctcagattttgatcaaatttcatggccaaactgatatttgaaaataacattttcaaaaattactcttaaaatctatggtggcagctttccaagtttgtggaacgcatcccattaagacaaccagccagttaaaaacgaatcagttagtaaaaagttttgtcaagacaacagtttccttcttttgatagattagatttgggactagagaatggaataaaccggctcttaactataactattagggagtgtctttatagtatttcttttctcatacatttactgataagccttgtcgaccttgacttctttatcaggctgatgtatgccatgcgtatcagctattgagaaaaggtggtctcaaagatgaaaatattattgtcttcatgtatgatgacattgctcaccatgaagagaacccaagaccaggagttattattaatagtcctgccggtgaggatgtttacgaaggagttcctaaggttggtgtttttcatcgtcatttaataaatacctaatctatacttccgtctcatgtgctatatctcgagtcaggattacacgggagatgatgttaatgtgcacaactttttagctgttctccttggtaacaaaactgctcttactggaggtagcggaaaggtggtgaatagtggtccaaatgatcatattttcatattctatagtgatcatggtggccctggcgtgcttggtaagtagcttatgtatgcctcttttggttgttgctttgctttctatatcttatgctttcatactaatttcgtcatgaaaattttgaaagcttgcatctgagtctgcaactcgagattttcatgtgtattgaatattaatgaccatagtctcactgctttctactatttgagaaatagatgatacctattcattctgtttctagttaggcaaacaaataatctttaattctgaatctgcttataccttttaacattctgtttgtttttgagttcagcaggacaattagttcaccaatagaaattatggtaatggtctcctaatccaacctcttcctctcagaaaacaaaaagaacactttatactcatggatacaatatcacagcttaacctttcctctttcatcctgattgacaattacatgtctgattttttgtaatataaatatctgtggtgaatatatcgccagcaaaggactcaacatattctctatctatcttgtctctttgtagtatctgtgcatgaaccactttcacattcaggcatcaagctttgaattgagtacctatgtctgtagttctatattgtgtggatcaataagaaagtgatattttcttggaagtgaattttaacagatacttccttcattccattttggcatgacattcttcttagccagttccaaacagaatgacacattatttacttaatgagaaaattttatagtcgcaggaaggctatgacatgtttaagacgacatgtttcataagttttgtagcctcaaaaacattttaaggaacatttaagaccactagaatgtcgttttaattgtgcatgtttgctgtcagtcaattatattttcataaacctgatttattgaattataggttggataaattatatcattgctatgtttataactactatactgtcatgtgtactagggatgcctaccaatccttatctatatgccgatgatctaattgctgtgttgaaaaagaagcatgccgctgggacatataaaagcttggtgagctgttatattcaattattttttaaatatttgtgaagccactttcgtattttccctaattttttaattgtttcttcttttgcttactatttccaggtattgtacattgaagcttgcgagtctggaagtatatttgagggacttcttcctaatggtctaaatatttatgccacaacagcttcaaatgctgaagaaagcagctggggaacctattgtcctggagaatatcctagtcctcctcctgaatatgagacttgcttgggtgatttgtatgctgtttcctggatggaggacaggtacctgcagcttttgaactttgctagccattttatataattaagcgggatggttttgagttttacttattttgtagttaaatgactgaagttcttgtccttttttttttgtctttgcctgaaattactgaattattttaatattccatgcggaagaatgtgcaaattgcaaacaaagatacatgcatgtgacttgccaatgcaacgagggacttgatatatgtgaatttctgtttgtgttacttgtccttttcaaatttggattttacagtctgatctggatttacgtttaaagaattacggttcagcttataactgttcacactagccctatacgttgttgctgaaccattttgtgtctctattgctgagcagtgaaatgcacaacttgcggactgaaaatttgaggcagcagtatcacttggtaagtacttttggacattgagaattaggttatctagctgatgtggtagttagaaagtaaaatgataacaaaataaggaatttagaatgctaaagcaaatgtattggtgttcttaaaagggaaaagaacaagggtttcacaagtaccgatccaatgatatagtttctctctatcctttattatgatgacataattgtgtattttgcatctctactgctgttttttgcaggtcaaaaagagaactgcaaatggaaatactgcctatggttcccatgtcatgcaatttggtgatctacaactgagtatggagtctctattcaggtttatgggtacaaatcctgcaaatgataactacacttatgtagatgacaattccttgttggcatcatcaaaggctgtcaaccagcgtgatgcagatcttttacatttctgggacaaggtatgccccaacaaacgccccctttcctgagtttgcgctaaacataagaagcaaaaatatcaaatactacataacaaatcagcaggaaataaagctgttgaatcttaaagaacatattagttaacagtatgtcctctttaaacaatatctttgcaccatcttgccaccattgatggtttcataaccatattaatgtggtatagctggtttccaaaaagacactaacattacatttatgaatggtagcaatgctaaacaggcgggtaacttgtgctaagctgcaagagttatttttagtaagccacatgttgtaattcgtgggtctttatgtgtttatgtattaattggcttgtgcctctgatgtgaaatgccttcttattgattttctattcttcctcaatgctggcagttccgcaaggctcctgaaggctctgctcggaaagttgaagctcagaaacaattcactgaagctatgtcacacagaatgcacctagatgaacgcattgcccttgttggtaagcttctgtttggaattcaaaaaggtcctgaggtgctgaagcatgttcgatctgcgggtcagcctcttgttgatgattgggcctgccttaaatcttttgtaagcacctcatagaactcttaattgttaagatttggttcatcatcgtagtttgacaattgtctttttgcaacttctatcatatctgcaggtaagaacatttgagtcgcactgcggatcgttatcccaatatggaatgaaacacatgcgttccattgccaatatctgcaatgctggaattcagatggagcagatggtggaggcatcagcacaagcttgtcctagcatcccttccaatatttggagttccctccacaggggctttagtgcgtaaaacgccatggactgtgcggtttctcactttgatgctggtaataataataattgctgttatcagtgtcatttcatgtcctatttgtaaattgcaatttgatcctgttattactgaagtctactattattgattatcaggattcacgtaatgtttgtaaattggtgctctgtaaatacagctgaacaagcacgacttatcatctttgattatatttgaaagcacatttctcattgcaagtaaacagtaagtcctctatacattgggatttttccctcgaataaattaaagggaactcattaatcaaagtcatattgcgaaaacaaagcatctaactagtagctgtcatagcttgaatccgtgaccttttaagttacacaaagacaattttaccattgcttcagatatgccatgaataataagcataaagatatcataattcatatgtaagaatgtcaccagggcacgttatttgatacttcaaccatatgaaacttcaaaaaggattaaaggccttgaaagaacagtagatcagatgattttgcaatggaaaaaaagaagagagctcatcaacactgatccatttgtgttcttagactgacttgaaacttcacaacaaagtgattactatacaggaaaaaagacggaggtggaaagaaagaggggaagggtggggtgcgggtagggggtgacacactgaccagattacctatccacattagtctccgtccccatagaacacgaaaacaagaaggatgagaaacagtacgactatggtttgatttgccaaccgtttatgatatcattggctagagacaacaacagcattttcatcagttggtgccgagtcagaggtagctgacttctttgtaagggacttgggaatgtcaaggtcatcttgcacgcaacgttgctgagggtgggaaagaagtgtacacatatgacggaataggacacgagtaagcccctgaccactctcaaatatgtaaccctcgtattcactgacatgttccagggcttcgacaagggcatcataaaccttttgagggcaattgtcaggtccaggtttgtcatgaaggtaaactacatccaaagtgaagagcttttgggtagcaggccattgatgctgtggtggtatagatgacctacaatatagaagtacctgcataataaagagaatacatgttaattaacacttgctagcaaccaatttgtacagagagaataaatttgcaagcattaga

SEQ ID NO: 551 - DNA, 4540 bp, Solanum lycopersicum
  modified_base (3847)..(4540): a, c, t, g, unknown or other
tgcactttgattatgattttattttattgtagttttcgaatattttgtcataccttttcttttatattttgttataattttttatcaaaaaattacgtaactatactgacgtataatagttagttatgctccataactacagtttaattcaatttttacaaataaaaaaatataattttttatctattacattctcaatttatttagaaaattaatttttccaaaagggataaaatcactcttaacaaataaattaattaataaaaataaaataataaatttaatatattaataattatttccaaaagtaatagttatttattgattgagggtaacaagaaacatgtgcataacaccatagattgctcttctaatgtgcatcaaacaaagggcttcaacttatttatgagtattttgggacagttacactcttacaattggaactctaaatatagcaccaaaatatctcacttgcttcattgttatattgacacatgactagtgttctttttcaatgcactacttcctctagtttatattaaataaattattgaccacagaaaataaataacgcgttatttttttaataattttcttgaactttaataattcatttactttagccatagaagaagtctttaacaattcatttatgcataatacgtgaacacatgctctttcacttaatttgtgttggtatttgtgtttttatttttaaatttgataagtagatacttaaacttatattgaattgaacaagtggatgcatataacatatcacacgtgaaatatcatgtaggatatatgaattaccacaaaaaacgtcatgtaagatgcttatgtctactaacatattaaaaattgctgaatataaatgcaagttaaaattaaattaaaaaatatttttatgtatcattcaattcatttaatatgaaccaaaatgattgagtagtattcaaaatccccttctataaataatgaatcatatctctattaactttgcctcatccatatgaccaatatctcattcaacaaaaacaaaggaagatagtaagtaatgaatatgaagggagttttagttgcttttgttttgattaatttgtcaatattggcaagttgtggggctccaaggaaggtaattgatgtgcctttttggaacaactatgaaccaagttggtctagtcaccatattaagtaccttaatggtggtactacggctgaacttcttcttgacaaatcctctggtaaacgagaatattttttttggtatcgtttcagtttatttatctcacttctatatttagtttatttaaaaaaacatacttaattttctttatttaattaattgacaagctctttaatcttatttttcgacatgttaaagattataatactataagaaaaatatacatgacaaataaattgaaactgagcaaatatattgaagcacataggctttttcatatctttgactctcgtcactgaaaattctagatccgctattaatttttttttttgaatggtatagccaataatgtactaattttgaatcttgaatgattgaaggaactggatttcaatcaaagagatcgtatctatttggtcatttcagcatgaaaatgaagcttgttggaggagattctgctggtgttgtcactgctttttatgtaagttaactagtacatattaaaaagaaagaatcgcaattttaattaaaatacaaagcatctgattttttttttttaaaaataatttgtaagtgattataagagatcatattcatattcttatactgatgaatgtttttattatcgatgatttgtcagttatcatcgactaatgctgaacacgatgagatagatttcgaattcctcgggaatagaaccggtcagccatacatattgcagactaatgtgttcacaggaggcaaaggagacagagaacagaggatctatctttggtttgatccaaccaaggactttcattcatattctgttctttggaacacttaccaaattgcgtaagttgatattttcttttcgtacgaagtgtatggtatgtaaatcttgttcctgtcttataagtactgacaataaaaatagtataataacccaactacttatttattctttaatcattttttaattttgaaactactaaacattaattaataaagccagtatgataaaacaatcatgtcaaatgttacttcatcggtttaaaaagggaaaatatccaagtaccccctcaacctatgcccgaaattccagagacacacttatactatactaaggtcctattatcccctctgaacttattttatatgtaattttctactcctttttagcctacgtggcactagttcagaaaaaaagtcaatcatcgttgggcccacaagatagtgccatgtaagctaaaaaggggtaaaaaaatatttataaaataagttcaggggtaataggaccttagtatagtataagtgtgtctctgagatttcgggcatagattgagggggtacttgggcattatcccgtttaaaaaagaatgaatttctttcattttagtctatttaaaaaagaatgatgtctttttttttgtaacaactttccacatgacatgtttaaggtcacaaaattaaaggacaattttatacatttgacataactttaatttaggaccacatgatcaaaagtgttctttattttcttaaactatgtgtcatgtcaaactagaccattctttgtgaaatggagagaacattttattaatgcgttccaagccaaatatgcaagtatagtgaaagtgggggtggggtggggtgaggtgggggtgttatagtattgaaatttttcattaggatgagagaaaattgcgtgactacttactaacaccatattctaatcttcgaatctaagcatttttctatcgagggttatgttttcgatgaattaggaaatgtgtcatcccttgtcaggtttaataatttctaaaaattaacaggatttttgtggatgatgtcccaataagagtattcaagaattcaaaagacataggagtgaaatttccgttcaatcagccaatgaagatctactcaagcctatggaacgcggatgattgggctacaagaggagggttagagaaaactaattggtctggggcgccattcatcgcttcctatacttcattccacattgatggatgtgaggctgtcacaccacaagaggtacaagtttgtaacaccaatggcatgaaatggtgggatcaaaaggctttccaagatttagatggccctgaatatagaaaacttcatagggttagacaaaatttcacaatatataactattgtactgatagaaaaaggtaccctacacttcctctagagtgtacaagggatagagatctttaattagttcttatttatatgggggcatttttcatttactctttatataaaaactaatccagtttgtatggagacgaattcaaaattataaaatttggactgtattgaagttctgaatatgtcaaattaaagattttaaaaattttaaaggttgtaccacacattgagcgctttgttcctaacaaatctcatggaagccaatcaagcgttacccaaaattcaaaagcctggaacaatttaatattaaaaaaatgaacatattatttaattcacctctaatctttgccatagagtcaaccttctttatcaatagatctaacatatcttcatttatattattagtagcataatatttggtactgaatccatttctgtctatcaatagaagttgagacacctataaactaggcttctaaatttattggaaaaaaaagttttgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 552 - protein, 426 aa, Solanum lycopersicum
MGLNGVDLTDDGDGGGGDVGGGEDKASVVSCSICLEAVTDNGDRSWSKLQCGHQFHLDCIGSAFNIKGQMQCPNCRKIEKGQWLYASGCRPLPDFNMEDWAHDEDLYDLSYTEMSFGVHWCPFSGLTRLPASFDEGELSSSAYHDLLGQHAIFADHTAVSSAAHPCPYIAYVGIHPSSSNSSGSINDGPNFNNHWTSPSVPNEIPASYAFPGMDVHYHSWDHHSSFPMASSRVGTADQSSVPSVTQRVARTNADIPRPGSFVPPFLVGHGSAARAGSSVASPMIPPYPGSVARARDRVQALQAYFQQPSNSPAVRTPVMSATRRSNNHRGLAQVGPAASSSDQAGGFYFYPSSSSGRNFQEAENPVSNRYHAWEREHLPAFPLSQVDRDPIWGPFHHTGVGSDSGSRAGSFRPRHGSERMPSQNRS

SEQ ID NO: 553 - protein, 700 aa, Solanum lycopersicum
MERIPEVRESTRQFPIGAKVAHTFSTSKKEVGIRGFRDFDLAIPIQTWKGKTSYQEEEDLMVDAGTIKRSDDSLEDSGSTSFHGASHPPEPVDTDLMRPVYVPIGQNKADGKCLVKNVSLKGPFLDDLSIRMPNVKPSPSLLSPAESLVEEPNDLGVISSPFTVPRPSQNTETSLPPDSEEKECIWDASLPPSGNVSPLSSIDSTGVVRSMSIVNSCTSTYRSDVLMSDGMLSVDRNYESTKGSIRGDSLESGKTSLSRASDSSGLSDDSNWSNITGSANKPHKGNDPRWKAILAIRARDGILGMSHFKLLKRLGCGDIGSVYLSELSGTRCYFAMKVMDKASLASRKKLTRAQTEREILQLLDHPFLPTLYTHFETDRFSCLVMEYCPGGDLHTLRQRQPGKHFSEYAARFYAAEVLLALEYLHMLGVVYRDLKPENVLVRDDGHIMLSDFDLSLRCAVSPTLIRISSDDPSKRGAAFCVQPACIEPTTVCMQPACFLPRLFPQKSKKKTPKPRADSGFQANSMPELVAEPTSARSMSFVGTHEYLAPEIIKGEGHGSAVDWWTFGIFLHELLYGKTPFKGSGNRATLFNVVGQQLKFPDSPATSYASRDLIRGLLVKEPQNRLGVKRGATEIKQHPFFEGVNWALIRCSTPPEVPRPVEPDYPAKYGQVNPVGVGNTSKRVVGADAKSGGKYLDFEFF

SEQ ID NO: 554 - protein, 243 aa, Solanum lycopersicum
MDKLINQENNIDKEIMELRRGPWTVEEDLVLMNYISHHGEGRWNSLSRCAGLKRTGKSCRLRWLNYLRPNVRHGNITLEEQLLILQLHSRWGNRWSKITQHLPGRTDNEIKNYWRTRVQKHAKQLKCDVNSRQFQDTLRYLWIPRLVERIEASKISNYNCINEAQQSIMRTHINNNFSTSVTLENSRVATSSKNSNQDYNQVNQSDQLWYEDYQAMDQQNNIELWMDNEDVFNNLCNIEDIWS

SEQ ID NO: 555 - protein, 275 aa, Solanum lycopersicum
MNTPMCASLGVRKGSWTEQEDSLLRDCIQKYGEGKWHLVPARAGLNRCRKSCRLRWLNYLRPHIKRGDFAPDEVDLILRLHKLLGNRWSLIAGRLPGRTANDVKNYWNTHFHKKLSIIAPHLHPHSRPRSHPRLQIKHKSIAVTKNEIIRPQPRNFSNVKKNDSHWCNNKSMITNTLDKDDKRCNEIVVNICEKPIGENTSSIDDGVEWWTNLLENCIEIEEETANTNFGKTPTMLLHEEISPPLVNGEDNSMQQGPTNNWDDFSTDIDLWNLLN

SEQ ID NO: 556 - protein, 578 aa, Solanum lycopersicum
MVEHDFHQQTQSLVKLVVLVCLLFLSASISVEARIRHYQWEVKYEYKSPDCFKKLSISINGKTPGPTIVAQQGDTVVVEVKNSLLTENLAIHWHGIRQIGTPWADGTEGVTQCPIVPGDTFIYKFVVDRAGTYLYHAHYGMQRQAGLQGMMRVSLPDGVLEPFSYDHDRSILLTDWYHKSTYEQATGLASLPFSWVGEPQSILIHGRGRFNCSIPTIDPTLCNATNPQCTPYSMTVVPGKTYRLRIGSLTALSALSFEIEGHNMTVVEADGHYVEPFVVKNLFIYSGETYSVLIKADQDPTRNYWASTKVVSRNNTTPNGLGIFNYYPNHPRRYPPTVPPSGPRWDDVAPRMAQSVAIKSHRDFIHAPPLTSDRVIVMLNTQNRVNGYVRWSVNNVSFNMPHTPYLIALKHNLLHAFEQTPPPDNYDQKNYDIFNIAPNVNATTSNSIYRLKFNTTVDIILQNANTMNLNNSETHPWHLHGHDFWVMGYGNGKFNQSIDPKNYNFVNPIMKNTIPVHPYGWTALRFRADNPGVWAFHCHIESHFFMGMGVVFEEGIEKVGKLPTSIMGCGESKRFHRP

SEQ ID NO: 557 - protein, 283 aa, Solanum lycopersicum
MSKEVIEEGQVQQHGKDYVDPPPAPLLDFAELKLWSFYRALIAEFIATLLFLYVTVATVIGHKKLNGADKCDGVGILGIAWAFGGMIFVLVYCTAGISGGHINPAVTFGLFLARKVSLVRAVGYIIAQCLGAICGVGFVKAFMTHPYNALGGGANFVQSGYNNGTALGAEIIGTFVLVYTVFSATDPKRSARDSHIPVLAPLPIGFAVFMVHLATIPITGTGINPARSFGAAVIADNKNVWDDQWIFWVGPFVGALLAAAYHQYILRAAAIKALGSFRSNATN

SEQ ID NO: 558 - protein, 447 aa, Solanum lycopersicum
MGSNYHFKNFGNEPPGEGGSGGGGKQPGNFGLPRQPSIYSLTFDEFLSSTGGSGKDFGSMNMDELLKNIWNAEENQTIGGPGINGQEVGVPGGHLQRQGSLTLPRTLSHKTVDEVWRDMSKEHGGGKDGNSVGVPPNIPQTQRQQNLGEITLEEFLVRAGVVREDAQFAAKSNNAGGIFGDLSYAGNNTGLAFGYHQANSRNTGLMAGSIPNKNGETVIQSANLPLNVNGVRSTQQQLRPQQLQQNQQSQPQQQPIFPKQPALPYGAPMAIPNSGQLGSPGMRAGMVGIPDPALNSNFIQGASLMGGGMNMVGLGASGVTVATASPGVSSSDGLGKSNGDTPSVSPVPYVFNGGLRGRKYSTVEKVVERRQRRMIKNRESAARSRARKQAYTMELEAEVAKLKEENDELQKKQEEMLEMQKNQVIEMMNLQKGAKRRCLRRTQTGPW

SEQ ID NO: 559 - protein, 338 aa, Solanum lycopersicum
MRSAGRMGIHYMQKLHASNVPKELVEKGQNRVIEASLTLIRERAKLKGELVRALGGAVASTSLLGVPLGHNSSFLQGPAFAPPRIREAMWCGSTNSTTEEGKELDDPRILTDVGDVPVQELRDAGVDDDRLMSIISESVKLVMEENPLRPLVLGGDHSISYPVVRAVSEKLGGPIDILHLDAHPDIYHAFEGNKYSHASSFARIMEGGYARRLLQVGIRSINKEGREQGKRFGVEQYEMRTFSQDRQFLENLKLGEGVKGVYISVDVDCMDPAFAPGVSHIEPGGLSFRDVLNILHNLQADVVGADVVEFNPQRDTVDGMTAMVAAKLVRELTAKISK

SEQ ID NO: 560 - protein, 331 aa, Solanum lycopersicum
MVSVYPTPPGQDFHYMGDPMKTGLMGLHPVQSGTSIHGNLNLDSNTGLVVSDDHSKKTRKPYTITKSRESWTEQEHDKFLEALQLFDRDWKKIEAFVGSKTVIQIRSHAQKYFLKVQKSGTSEHVPPPRPKRKASHPYPQKAPKKVISQVGSIQFQPPGALPVPGFGIGPDPLSVPGNTINFSPWTYDNVPAISTIQTRKDDAQLSSGGVKQNCSSSSNENNPRINKTKESNDQNESQKQMKVMPDFAQVYSFIGSVFDPSTRDHLQRLKKMDPIDIQTALMLMKNLSFNLSSPEFEDHRRMLSSYGLGAEKDKMDLPIKSDFRGNAIRAI

SEQ ID NO: 561 - protein, 265 aa, Solanum lycopersicum
MATSAIQHSAFAGQTALKSQNEFIRKIGSFEGGRVTMRRTVKSAPQSIWYGEDRPKYLGPFSEQTPSYLTGEFPGDYGWDTAGLSADPETFARNRELEVIHCRWAMLGALGCVFPEILSKNGVTFGEAVWFKAGSQIFSEGGLDYLGNPNLIHAQSILAIWASQVVLMGFVEGYRVGGGPLGEGLDKIYPGGAFDPLGLADDPEAFAELKVKEIKNGRLAMFSMFGFFVQAIVTGKGPIENLSDHIADPVANNAWAYATNFVPGK

SEQ ID NO: 562 - protein, 547 aa, Solanum lycopersicum
MPVSVTISSFSLLTDTHHRTTVIRPKNPLQNRSQLTIKSSIDNKKPPSTKPTSWVSPDWLTKLTRSLTLGQNDDSNIPIASAELDDVSELLGGALFLPLYRWMNLYGPIYRLAAGPRNFVIVSDPAIAKHVLKNYGKYGKGLVAEVSEFLFGSGFAIAEGPLWTARRRAVVPSLHKKYLSVIVDRVFCRCAERMVEKLLPDAISGSAVNMEAKFSQLTLDVIGLALFNYNFDSLTTDSPVIDAVYTALKEAELRSTDLLPYWQIKALCKFIPRQIKAENAVSLIRQTVEELIAKCREIVETEGERINEDEYVNDRDPSILRFLLASREEVSSLQLRDDLLSMLVAGHETTGSVLTWTAYLLSKDPSSLEKAHEEVDRVLGGRSPTYEDMKNLKFLTRCITESLRLYPHPPVLIRRAQVADVLPGNYKVNVGQDIMISVYNIHHSSEVWDRAEEFDPERFDLEGPVPNETNTDFRFIPFSGGPRKCVGDQFALLEATIALAIFVQNFSFELIPDQTISMTTGATIHTTNGLYMKVKQREKVSVLAAAP

SEQ ID NO: 563 - protein, 439 aa, Solanum lycopersicum
MDESKEETKSFKELGVCDQLIEACDNLGWKNPSKIQAEAMPHAFEGKDLIGLAQTGSGKTGAFAIPILQSLLDSPHAFFACVLSPTRELAIQIAEQFEALGSGIGVKCAVLVGGIDQVQQSIALGKRPHIVVATPGRLLDHLSNTKGFSLRTIKYLVLDEADRLLNEDFEKALDQILNAIPHERRTYLFSATMTKKVRKLQRACLRNPVKIEAASKYSTVDTLKQQYRFLPAKYKDCYLIYILTEMSGSTSMVFTRTCDATRLLALMLRNLGLRAIPISGQMTQDKRLGALNKFKAGECNILICTDVASRGLDIPSVDMVINYDIPTNSKDYIHRVGRTARAGRSGVAISLVNQYELEWYIQIEKLIGKKLPEYPAEEEEVLLLLERVTEAKRISLMKIKETGGKRKHRGGGDDGDDQEVHKYLGVNKKGKQSKKPKRK

SEQ ID NO: 564 - protein, 206 aa, Solanum lycopersicum
MADQYEQNKASVEETVGTNVEATDRGLFDFIGKKEEEKPSHAHEEEAISSELSEKVNVSEEVEPKEEEKKLHRSNSSSSSSSDEEEEIGEDGQKIKKKKKKGLKDKIKEKISGDHKEESKAEDTSVPVEKYEETEEKKGFLDKIKEKLPGGGHKKTEEVAAPPPPPPAAVEHEAEGKEKKGFLDKIKEKLPGYHSKAEEEKEKEKD

SEQ ID NO: 565 - protein, 455 aa, Solanum lycopersicum
MEAFHHPPISFHFPYAFPIPTPTTNFLGTPNSSSVNGMIINTWMDSRIWSRLPHRLIDRIIAFLPPPAFFRARVVCKRFYGLIYSTHFLELYLQVSPKRNWFIFFKQKVPRNNIYKNVMNSSNSGVCSVEGYLFDPDNLCWYRLSFALIPQGFSPVSSSGGLICFVSDESGSKNILLCNPLVGSIIPLPPTLRPRLFPSIGLTITNTSIDIAVAGDDLISPYAVKNLTTESFHIDGNGFYSIWGTTSTLPRLCSFESGKMVHVQGRFYCMNFSPFSVLSYDIGTNNWCKIQAPMRRFLRSPSLVEGNGKVVLVAAVEKSKLNVPRSLRLWALQDCGTMWLEIERMPQQLYVQFAEVENGQGFSCVGHGEYVVIMIKNNSDKALLFDFCKKRWIWIPPCPFLGNNLDYGGVGSSNNYCGEFGVGGGELHGFGYDPRLAAPIGALLDQLTLPFQSFN

SEQ ID NO: 566 - protein, 240 aa, Solanum lycopersicum
MDSSSSSSQFFYSMNSDLNSSDSSYEWSNFNTQSYLPFNVNDSEEMLLFGVLNAAHEETTSETVTSHRVKEEEVTSESEVIEAIPAKEKSYRGVRRRPWGKFAAEIRDSTRNGVRVWLGTFDSAEDAALAYDQAAFSMRGNSAILNFPVETVRDSLRDMKCHVDDDCSPVVALKKRHSMRKRSTNSKKVNSISKVVREVKMENVNNVVVFEDLGADYLEQLLSSSSSDQSSCDATYFSPW

SEQ ID NO: 567 - protein, 224 aa, Solanum lycopersicum
MSSPLEIDTSFSHSNLLFLEDESSWSNTHDPFVDIDEYLPIIIPCNDEEIVVESSNTSTTTTTTTTSKVASIQNIHHDQEEVTSIEKKHEDDQEKHYIGVRKRPWGKYASEIRDSTRNGIRVWLGTFDTAEEAALAYDQAALSMRGPWSLLNFPMEHVKKSLENIEYSCKDGLSPAAVLKATHKTRRVKHKRSSRKKKNENLENVFVFQDLGVELLEELLMTSS

SEQ ID NO: 568 - protein, 260 aa, Solanum lycopersicum
MCGGAILADIIPPRDRRLSSTDLWPTDFWPISTQNVPLNPKRARPSTGGEQMKKRQRKNLYRGIRQRPWGKWAAEIRDPRKGVRVWLGTFNTAEEAARAYDREARKIRGKKAKVNFPNEDDDHYCYSHPEPPPLNIACDTTVTYNQESNNCYPFYSIENVEPVMEFASYNGIEDGGEEMVKNLNNRVVEEEEKTEDEVQILSDELMAYESLMKFYEIPYVDGQSVAATVNPAAETAVGGGSMELWSFDDVSRLQPSYNVV

SEQ ID NO: 569 - protein, 222 aa, Solanum lycopersicum
MAPKEKIGAVTAMAMVNLNGISKEVHYRGVRKRPWGRYAAEIRDPGKKSRVWLGTFDTAEEAARAYDNAAREFRGAKAKTNFPKLEMEKEEDLKFAVKNEINRSPSQTSTVESSSPVMVDSSSPLDLSLCGSIGGFNHHTVKFPSSGGGFTGSVQAVNHMYYIEALARAGVIKLETNRKKTVDYLGGGDSDSSTVIDFMRVDVKSTTAGLNLDLNFPPPENM

SEQ ID NO: 570 - protein, 201 aa, Solanum lycopersicum
MTKQDEGLTLELIRQHLLEDFTTTESFIDSLNSCFSDHISSSDDISPVFTSVKTEPSTSNSLSDSPNSSYPNEPNSPISRYFNLRSDFPEFKIDSDTILSPVFDSSAGSNEDNNKKKNYRGVRRRPWGKFAAEIRDPSRKGSRIWLGTFDTDIDAARAYDCAAFKMRGRKAILNFPLDAGKSGAPANVGRKRRRENKMELV

SEQ ID NO: 571 - protein, 244 aa, Solanum lycopersicum
MGSPQETCTSLDLIRQHLFDESLDQTCFSFETTQTSNLDDIASFFNATSKTEYDGFFEFEAKRHVIHSNSPKQSNLRERKPSLNVAIPAKPVVVVENVEIEKKHYRGVRQRPWGKFAAEIRDPNRKGTRVWLGTFDTAVDAAKAYDRAAFKLRGSKAILNFPLEVANFKQQNDETKTEMKSSGSKRVRGETEELVIKKERKIEEERVLPTAAAPLTPSSWSTIWDEKGIFEVPPLSPLSQLVMI

SEQ ID NO: 572 - protein, 437 aa, Solanum lycopersicum
MMLKIKRVPTLVSNFQKDEADEIAARGAGCGRNCLRNCCLPGSKLPLYGFKNLSYGKSVADETKESPIDFLESLVLGEWEDRQQKGLFRYDVTACETKVIPGEYGFVAQLNEGRHLKKRPTEFRVDKVLQPFDGSKFNFTKVGQEELLFQFEASEEDEVQLYPDAPIDPEKSPSVVAINVSPIEYGHVLLIPKVLECLPQRIDRDSFLLALHMAAEAANPYFRLGYNSLGAFATINHLHFQAYFLAVQFPIEKAPTQKITVTDAGVKISEMLHYPVRGLVFEGGNTLEDLADVVSDSCICLQENNIPYNVLISDSGKRIFLLPQCYAEKQALGEVSAELLDTQVNPAVWEISGHMVLKRKEDYEGATEANAWRLLAEVSLSEARFQEVTALIFEAISLSVEENEDGTDGSPEDLDVTPPQPMEEIDGLNTHSTMVPA

SEQ ID NO: 573 - protein, 470 aa, Solanum lycopersicum
MLILSAASSSSSSSSSFMLSSASSSSARIPRPLSSFSTCVPVVVTTVSSAATSTLFPISCFGVKSRTVGIRKLRCAVFCASKVRGMAEMIEDAMTVSASESHELPQSRDFLDARTGEDLLSAVRKAVEDEKLPLNVAEGMEELYQNYQNAVLQSGVPKADEAILYNMALVFDRVFVDVKDPFEFSPYHKAIREPFDYYKFGQNYIRQLVDFRSSYVGNMSAFSEMAEKLKQGDNVVLMSNHQSEADPAIIALLIESKLPDIAENIIYVAGDRVITDPLCKPFSMGRNLLCVYSKKHMNDDPELAEMKKRANTRSLKEMALLLRGGSKIIWIAPSGGRDRPDPVTKEWYPAPFDASATDNMRRLVQHAGVPGHIYPLAILCHDIMPPPAQVEKNIGEKRVVSFHGAGISVAPKIDFHEVAGALEDPEAKMVYTKAIYDSVSQQYNVLNSAIHGKQGLEASIPSVSLSQPWQ

SEQ ID NO: 574 - protein, 292 aa, Solanum lycopersicum
MATFNISFLTQPAIFSSQNTPSFSSYSLPKTSFRFPSITLRPKTRTTTRHHASIVVAALKKLSETDPLTVPLQSDEIAGSFPKESGVYAVYDTNGDLQFVGISRNIAASVISHKNSVPQLCSSVKVGVVEEPDRTALTESWKSWMEEHITTNGKVPPGNEPGNSTWVRQPPKKKADLRLTPGRNVQLTVPLEDLIDRLVKENKVVAFIKGSRSAPQCGFSQRVVSILESEGVDYESIDVLDEEYNSGLRETLKNYSNWPTFPQIFVKGELVGGCDILTSMYEKGELASLFKS

SEQ ID NO: 575 - protein, 527 aa, Solanum lycopersicum
MEPNSYGSGKAAVGDGVGAPMLQTAPAPAPIPSANAPPPFLVKTYDMVDDPSTDKIVSWSPTNNSFVVWDPPEFAKDLLPKYFKHNNFSSFVRQLNTYGFRKVDPDRWEFANEGFLRGQKHLLKSISRRKPAHGHAQQQQQPHGNAQQQMQPPGHSASVGACVEVGKFGLEEEVERLKRDKNVLMQELVRLRQQQQATDNQLQGMVQRLQGMELRQQQMMSFLAKAVNRPGFLAQFVQQQNESNKRIAEGSKKRRIKQDIESQDPSVTPADGQIVKYQPGINEAAKAMLRELSKLDSSPRLDNFSNSPESFLIGDGSPQSNASSGRVSGVTLQEVPPTSGKPLLNTASAIAGQSLLPATSEMQSSHLGTCSEIINNQLSNIIPLVGGEDLHPGSLSASDMIMPELSQLQGILPENNTDVIGCDSFMDTSAVEGKVGLDIIGSCLSPGADIDWQSGLLDEIEEFPSVGDPFWEKFLQSPCSPDAAMDDDISNTSETKPQINGWDKTQNMEHLTEQMGATNIKQQKHMI

SEQ ID NO: 576 - protein, 235 aa, Solanum lycopersicum
MAYTSLTSSPLVSNVSVGGTSKINNNKVSAPCSVFVPSMRRPTTRLVARATGDNKDTSVDVHHSSAQGGNNQGTAVERRPTRMALDVSPFGVLDPMSPMRTMRQMIDTMDRLFEDTMTFPGRNRASGTGEIRTPWDIHDDENEIKMRFDMPGLSKEDVKVSVENDMLVIKGEHKKEEDGRDKHSWGRNYSSYDTRLSLPDNVVKDKIKAELKNGVLFISIPKTEVEKKVIDVQIN

SEQ ID NO: 577 - protein, 531 aa, Solanum lycopersicum
MLSRVNSMQVWDMEGKQEEEKEENFSNKENTTNVELENKQDMELGALSTFKSMLDGTDVDWYHNNMQNHTENICFTQNFTELAENSMFLQPVVPVDSSSSCSPSSVSVFNNLDPSQVHYLLAQKAINNNPLDYSFNLGCENGFLEAQGMGGLNKGGFLLAGGGFHDLSSQNQMGNPNLNSFTQYPSSHLPQNTTTTGFSPLGFVDGSANENSLFLNRSKLLKPLDNFASNGAQPTLFQKRAALRKNLANTTGGSLGDFGGEIGQNSMNGENERKRKWGSGEELDDVSFDGCTLSYDSDDLTENVTNKVDDTVKNGGNSSNATSTVTCGNQKGKKKGLPAKNLMAERRRRKKLNDRLYMLRSVVPRISKMDRASILGDAIEYLKELLQKINDLHNELESTPPSSSLTQTTSFYPLTPTGPALPGRIKEELYPSSFASPLSSPTGQPARVEVKAREGRAVNIHMFCSRRPGLLLSTMRALDNLGLDIQQAVISCFNGFALDIFRAEQCKEGQDFHPDQIKAVLLDSAGCHGMI

SEQ ID NO: 578 - protein, 372 aa, Solanum lycopersicum
MCGGAIISDLVPPSRISRRLTADFLWGTSDLNKKKKNPSNYHSKPLRSKFIDLEDEFEADFQHFKDNSDDDDDVKAFGPKSVRSGDSNCEADRSSKRKRKNQYRGIRQRPWGKWAAEIRDPRKGIRVWLGTFNSAEEAARAYDAEARRIRGKKAKVNFPDEAPVSVSRRAIKQNPQKALREETLNTVQPNMTYISNLDGGSDDSFSFFEEKPATKQYGFENVSFTAVDMGLGSVSPSAGTNVYFSSDEASNTFDCSDFGWAEPCARTPEISSVLSEVLETNETHFDDDSRPEKKLKSCSSTSLTVDGNTVNTLSEELSAFESQMKFLQIPYLEGNWDASVDAFLNTSAIQDGGNAMDLWSFDDVPSLMGGAY

SEQ ID NO: 579 - protein, 605 aa, Solanum lycopersicum
MATTTSHATNTWIKTKLSMPSSKEFGFASNSISLLKNQHNRQSLNINSSLQAPPILHFPKQSSNYQTPKNNTISHPKQENNNSSSSSTSKWNLVQKAAAMALDAVESALTKHELEHPLPKTADPRVQISGNFAPVPENPVCQSLPVTGKIPKCVQGVYVRNGANPLFEPTAGHHFFDGDGMVHAVQFKNGSASYACRFTETERLVQEKALGRPVFPKAIGELHGHSGIARLMLFYARGLFGLVDHSKGTGVANAGLVYFNNRLLAMSEDDLPYHVKVTPTGDLKTEGRFDFDGQLKSTMIAHPKLDPVSGELFALSYDVIQKPYLKYFRFSKNGEKSNDVEIPVEDPTMMHDFAITENFVVIPDQQVVFKMSEMIRGGSPVVYDKNKVSRFGILDKYAKDGSDLKWVEVPDCFCFHLWNAWEEAETDEIVVIGSCMTPPDSIFNECDEGLKSVLSEIRLNLKTGKSTRKSIIENPDEQVNLEAGMVNRNKLGRKTEYAYLAIAEPWPKVSGFAKVNLFTGEVEKFIYGDNKYGGEPLFLPRDPNSKEEDDGYILAFVHDEKEWKSELQIVNAMSLKLEATVKLPSRVPYGFHGTFINANDLANQA

SEQ ID NO: 580 - protein, 283 aa, Solanum lycopersicum
MSKDVIEEGQAHHHGKDYVDPPPAPLLDMAELTKWSFYRALIAEFIATLLFLYVTVATVIGHKKLNALDQCDGVGILGIAWAFGGMIFVLVYCTAGISGGHINPAVTFGLFLARKVSLIRAVAYIIAQSLGAICGVGFVKAFMKHYYNTEGGGANFVQPGYNNGTALGAEIIGTFVLVYTVFSATDPKRSARDSHVPVLAPLPIGFAVFMVHLATIPITGTGINPARSFGAAVIYGNEKIWDDQWIFWVGPMVGAMAAAIYHQFILRAGAVKALGSFRSNQTN

SEQ ID NO: 581 - protein, 328 aa, Solanum lycopersicum
MAAITQRKDSDRIKGPWSPEEDELLQTLVEKHGPRNWTLISKSVPGRSGKSCRLRWCNQLSPQVEHRAFTPEEDDTIIRAHAKFGNKWATIARLLSGRTDNAIKNHWNSTLKRKCPSMSEDLSFETPQPPLKRSSSVGPCTNFSSVMNPGSPSGSDLSDSSLSGFPQSHVYRPVPRTGGIFPLPPPPPVKQIEIPPSVPDPPTSLCLSLPGSGSGSIEKPTQSPKSPPLPPPPLPAVDKPIPPSVPVTCPPSAFMGHLAQSNQSYDFSAAPKSGEKQFFTPEFLSVLQDMIRKEVKSYMSGFEQNGLCMQTDAIRNAVIKRIGISKIE

SEQ ID NO: 582 - protein, 441 aa, Solanum lycopersicum
MSEVRDPSIKLFGKTIGMTQQETNCVYLHDDHTTSSPLSIDDEKINLEGEVTQSKQVDELVDPAADSSIEPETSSGISDDIKMQDADKETLSSKSVEEEDSSEEKALKKPDKLIPCPRCNSMETKFCYYNNYNVNQPRYFCKNCQRYWTAGGTMRNVPVGSGRRKNKSSSISNYPLQAGRVEAAAHGMHLPASRTNGTVLTFGSDKPLCDSMVSALNLAENSHNMHRNEYHGSEQRMPTIGNDQSNGSCSTASSVTDKESSAGTHDLANWSNFQPFPPQVPYFQGAPWPYSGFPVSFYPAAPYWGCTVSNPWNVPWLSSNQSVHNNSPTSPTLGKHSRDESKLDPSQSRRRDTTLQDREGERCVLIPKTLRIHDPNEAAKSSIWSTLGIRNEKIDSTRGTMLFSAFNPKADHRNRELDTSFALQANPAALSRSLHFRESTR

SEQ ID NO: 583 - protein, 192 aa, Solanum lycopersicum
MSKRIRESDEKGNKHPIYRGVRMRSWGKWVSEIREPRKKSRIWLGTYPTAEMAARAHDVAALSIKKDSSILNFPHLIDSLPRPISLSPRDVQAAAAEAAAMEDLNYVSSTSSVSSIDKITSASEELGEIIELPSLDGSFESEESKTELKISDSVDGWLYPPWWASDGDFDGYLFEQDAVGNSLILSNFEMMK

SEQ ID NO: 584 - protein, 289 aa, Solanum lycopersicum
MSNEVSSALPERSSSPAKDYHEPPPAPFIGAAELKKWALYRALIAEFVATLLLLYIGQLTIMGYKSESDHDPCGSVGLLGVAWVFGGMVFILVYCTAGISGGHINPAVTFGLFLSRKISLIRGLLYIVVQYLGAICGTALVKAIYKSKFELYGGGVNSVSPGYTRGVAWSAEMIGTFVLVYTVLSATDSKRNARDSHVPVLAPLPIGFAVFLVHLATIPITGTGINPARSLGAAVIYNQQIAWEDPWDLFWRTFHRSTYCSNLPTNTEGMQMEISDATYICSRICVCDL

SEQ ID NO: 585 - protein, 278 aa, Solanum lycopersicum
MASAVVAGAASSSCSVSYSRNLSITKSNSSIPSLKSSTTPSQRTSFQGLSLQEAKRGVSNTFLGAESKRNATSNGGSRGLEITARKAAAAKNIEVEVDKPLGLTLGPKQGGGVLITGIDNGGNAARAGLKVGDQVVYTSSFFGDELWPADKLGFTKTAIQAKPDSVYFVISRGADVDVKRLPKRPAPPQFGRKLTDAQKARATHICLDCGYIYTLPKSFDEQPEDYACPQCIAPKKRFARYDVNTGRAIGGGLPPIGVIIGLIAGIGGVGALLVYGLQ

SEQ ID NO: 586 - protein, 485 aa, Solanum lycopersicum
MALIVEKTTSGREYKVKDMSQADFGRLEIELAEVEMPGLMACRTEFGPSQPFKGAKITGSLHMTIQTAVLIETLTALGAEVRWCSCNIFSTQDHAAAATARDSAAVFAWKGETLQEYWWCTERALDWGPGGGPDLIVDDGGDATLLIHEGVKAEEEYAKTGKFPDPNSTDNVEFQLVLTIIKDGLKSDPLKYTKMKERLVGVSEETTTGVKRLYQMQANGTLLFPAINVNDSVTKSKFDNLYGCRHSLPDGLMRATDVMIAGKVALIAGYGDVGKGCAAAMKQAGARVIVTEIDPICALQATMEGLQVLPLEDVVSGIDIFVTTTGNKDIIMVDHMRKMKNNAIVCNIGHFDNEIDMLGLETYPGVKRITIKPQTDRWVFPDTKSGILVLAEGRLMNLGCATGHPSFVMSCSFTNQVIAQLELWKEKASGKYEKKVYVLPKHLDEKVAALHLGQLGVKLTKLSKDQADYISVPVEGPYKPAHYRY

SEQ ID NO: 587 - protein, 208 aa, Solanum lycopersicum
MDYSRRLLREATMSPPPAARISHDTPLGHRVNTIDANVIMVLAVLVCALICSLVLNSIIKCAFKCSSLILADPSSNHTSNNNSSSTKLVNRGIKKKALKTFPVITYSTTEPKHPGLDSECVICLSEFGVGDKIKVLPKCNHGFHVRCIDKWLNSHSSCPTCRHSLIDTCEKIVNGGNSSTTNNNIREAAVQQVIVRIEPLQREGVISN

SEQ ID NO: 588 - protein, 408 aa, Solanum lycopersicum
MAVLDRTSNMMLPMDYTRKKKSRSRKDAPKNVAETLAKWKEVNEKLDACDDDGRKPVRKVPAKGSKKGCMKGKGGPDNGRCKYRGVRQRTWGKWVAEIREPHRGRRLWLGTFDTAIEAALAYDEAARAMYGPCARLNLPDYYASSKESSKDDSSLPTVSRSDSNTASSFSEVCPAGDMMRGRANVPAARHEDRSIEIDGARTGSNEIGTPLSSLREEAEDETKEVSDKSETFTPLSSLREQAEDEAKQVLDKSETFEIKDEPAACSYDSWDIGQEDLGNFCLDDEMFDVNELLGMMDSTPVDASAPSQDVGFVPPKQEQYAYDPSYQLHSAAYDANQLSNPAYQLDNADDQFSNPLYQLENAGVDTLEGLQQMEQQSPIEVEYDFDFLRPGRQEDFHFCLDELDVLDF

SEQ ID NO: 589 - protein, 231 aa, Solanum lycopersicum
MDNKPETSLDNPVHQRSEPGSETGSSLSTITTHHLTVPPGLTPEEFQELSSSIAEFHSYRINPGQCSSLLAQRIHAPVETVWTVVRRFDKPQTYKHFIKSCSVGEDFRMTVGSTRDVTVISGLPAATSTERLDILDDDRHVTGFSIIGGEHRLRNYRSVTTVHGFERDGEIWTVVLESYVVDVPEGNTEEDTRLFADTVVKLNLQKLASVTETLAREAGNGSVNSRDASHR

SEQ ID NO: 590 - protein, 262 aa, Solanum lycopersicum
MEFSKITSLLFISMLFLSSFTPILGCGYCGKPSHKPKKPKVPSPIVKPPVDLPPIGIPPIVKPPVNLPPIGIPPIVKPPVNLPPVGIPPIVKPPVNLPPVGIPPIVKPPVKLPPIGIPPVVKPPVDLPPVGIPPVTVPPIVKPPVDLPPVGIPPVTVPPVLKPSPKGKKPCPPTTKATCPIDTLKLGACVDLLGGLVHIGLGDPAVNECCPILSGLVELEAAACLCTTLKVKLLNLKIYVPLALQLLVTCGKSPPPGYTCSI

SEQ ID NO: 591 - protein, 162 aa, Solanum lycopersicum
MALVSGGRSSTLNPNAPLFIPSYVQQVEDFSPEWWNLVTTATWFRDYWTSQHQGEEYGDDDFGFAGNDVADLLPENIDLDVDEDILNMEAQFEEFLQSSETEQQGIKSSLSGVNGLPKGSEALVRTLSMPKPKSPIEPPKLYEKPAKIVSPKNSLRRIQQPR

SEQ ID NO: 592 - protein, 241 aa, Solanum lycopersicum
MALEQLDTTFNKHDTPLGKWKTMNDEVEENISSGFECNICLDLVHDPVVTLCGHLYCWPCIYKWIHFQSVPSENLDQQQPQCPVCKAEVSQKTLIPLYGRGGQSTKPSEGKAPNLGIVIPQRPPSPRCGGHLLIPTTDSSPSHLLQRRNHQQQSQTRQSPYQQSASPGTTVDMLQPSMIGQVAYARIFGNSSTTLYAYPNSYNLAISSSPRMRRQLSQADRSLGRICFFLFCCFVTCLILF

SEQ ID NO: 593 - protein, 379 aa, Solanum lycopersicum
MATQGQVITCKAAVAWEPNKPLVIEDVQVAPPQAGEVRVKVLYTALCHTDAYTWSGKDPEGLFPCVLGHEAAGIVESVGEGVTEVQPGDHVIPCYQAECRECKFCKSGKTNLCGKVRAATGVGVMMNDRKSRFSINGKPIYHFMGTSTFSQYTVVHDVSVAKIDPVAPLEKVCLLGCGVPTGLGAVWNTAKVEPGSIVAVFGLGTVGLAVAEGAKAAGASRIIGIDIDSKKFDRAKNFGVTEFINPKEHEQPIQQVIVDLTDGGVDYSFECIGNVSVMRSALECCHKGWGTSVIVGVAASGQEISTRPFQLVTGRVWKGTAFGGFKSRSQVPSLVDKYLKKEIKVDEYITHNLTLADINKAFDLMHDGDCLRVVLDMFV

SEQ ID NO: 594 - protein, 171 aa, Solanum lycopersicum
MKILIFLIMFLAMLLVTSGNNNLVETTCKNTPNYNLCVKTLSLDKRSEKAGDITTLALIMVDAIKSKANQAANTISKLRHSNPPQAWKDPLKNCAFSYKVILTASMPEAIEALTKGDPKFAEDGMVGSSGDAQECEEYFKATTIKYSPLSKLNIDVHELSDVGRAIVRNLL

SEQ ID NO: 595 - protein, 386 aa, Solanum lycopersicum
MCGGSIISDYIDPSRTSRRLTAEFLWGRFDLGKKQKNPNNYHSKAKHLRSEVVDDFEADFQDFKELSDDEDVQVDVKPFAFSASKHSTGSKSLKTVDSDKDAAADKSSKRKRKNQYRGIRQRPWGKWAAEIRDPRKGVRVWLGTFNTAEEAAKAYDIEARRIRGKKAKVNFPDEAPAPASRHTVKVNPQKVLPEESLYSLQSDSAIMNSVEDDHYDSFGFFEEKPMTKQYGYENGSSASADTGFGSFVPSAGGDIYFNSDVGSNSFECSDFGWGEPCSRTPEISSVLSAAIECNEAQFVEDANSQKKLKSCTNNPVADDGNTVTMVPEELPAFEPQMNFFHLPYMEGNWDASGGNFLNTSATQNGGENAMDLWSFDDVPSLMGGIF

SEQ ID NO: 596 - protein, 201 aa, Solanum lycopersicum
MGTPSYDIKNKGDDMQEEPKVKLHHEKGGDEKEKIIEKETPSQDINNKDTISSYVLTGDDTQEIPKMEHEEGGYVKEKIVEKETISQYIIKIEGDDDAQEKLKVEYEEEEYEKEKIVEKETPSQDINNKGDDAQEKPKVEHEEGDDKETPSQDIIKMEGEGALEITKVVCEKIIVREDLAVQSKPPSKRDPPKMQTDNNKL

SEQ ID NO: 597 - protein, 210 aa, Solanum lycopersicum
MATLALRRATASSLFNRLVNPVRSASAFRSFNTNTQMTAYDQDDRGVDVDRRSDRSVSRRDAFPSLFSDVFDPFSPPIRSVSQLLNMMDQMMDSPFVAAPRAMGAGVGARRGWDVKEDDNALYIKMDMPGLDKENVKVAVEENTLIIKGEGEKESENEEYRRRYSTRLEIPQNIYKLDGIKAEMKNGVLKVAVPKVKQEERKDVFDVKIE

SEQ ID NO: 598 - protein, 301 aa, Solanum lycopersicum
MNKGANGNQQLELPAGFRFHPTDDELVQHYLCRKCAGQSIAVSIIAEIDLYKFDPWQLPEKALYGEKEWYFFSPRDRKYPNGSRPNRAAGTGYWKATGADKPVGKPKTLGIKKALVFYAGKAPRGIKTNWIMHEYRLANVDRSAGKNNNLRLDDWVLCRIYNKKGTLEKHYNVDNKETTSFGEFDEEIKPKILPTQLAPMPPRPRSTPANDYFYFESSESMTRMHTTNSSSGSEHVLSPCDKEVQSAPKWDEDHRNTLDFQLNYLDGLLNEPFETQMQQQICNFDQFNNFQDMFLYMQKPY

SEQ ID NO: 599 - protein, 296 aa, Solanum lycopersicum
MTAAELQLPPGFRFHPTDEELVTHYLCRKCTSQPIAVPIVAEIDLYKFDPWDLPDLALYGEKEWYFFSPRDRKYPNGSRPNRAAGTGYWKATGADKPIGNPKAVGIKKALVFYSGKAPKGEKTNWIMHEYRLADVDRSARKNNNSLRLDDWVLCRIYNKKGSIEKNRKMNTTCYMDKVGSPEDRKPEILPPLPPHPQPQQLHNDFFYLPSDSVPKMHSDSSCSEHVLSPEFTCEREVQSEPKLTDWEKATLDLPFNYMDATTGATTVDNSLLGSQFQSSYQMSPLQDMFMHLHKPF

SEQ ID NO: 600 - protein, 531 aa, Solanum lycopersicum
MEDHLQISPAGAKAIPGKEQQAAGYGILLQIMMLVLSFVIGHVLRRRHFYYIPEASASLLIGLIVGGLANVSDTETSIRAWFNFHEEFFFLFLLPPIIFQSGFSLSPKPFFSNFGAIITFAILGTFIASFVTGILVYLGGVTYLMYRLPFVECLMFGALISATDPVTVLSIFQELGTDVNLYALVFGESVLNDAMAISLYRTMSLVRSHMSTDQNYFMITIRFVETFMGSLSAGVGVGFVSALLFKYAGLDIDNLQNLESCLFVLFPYFSYMLAEGLGLSGIVSILFTGVVMKRYTYPNLSESSQRFVSAFFHLISSLAETFVFIYMGFDIAMEKHSWSHVGFIFFSILFIVIARAANVFGCAYLVNLVRPPHQKIPAKHQKALWYSGLRGAMAFALALQSVHDLPEGHGQTIFTATTAIVVLTVLIIGGSTGTMLEALEVVGDGQSGSMDETFEGNNGYIAPSYSDESYDGEPSSGNRFRMKLKEFHKSTTSFSALDKNYLTPFFTTQGGDEDEDEPIMHSSRRAGYDGH

SEQ ID NO: 601 - protein, 989 aa, Solanum lycopersicum
MRGLPGHERRWTSDTVSSGKDLSGESSPGTDSGNISGFASEEFVEVILDLQDDDTIILRSVEPATVINIDGSDPASGVGIGGASIETPASVTSTSETRSPMMRRSTSNKFRQFSQELKAEAVAKAKHFSQELKAELRRFSWSHGHASRAFSPASFFQNAVVGTGNGVDSALAARALRRQRAQLDRTRSSAHKALRGLKFISNNKTNGWNEVENNFAKLAKDGYLYRSDFAQCIGQYSRRRSLQFNYRLITLILINYLVKGMKDSKEFALELFDALSRRRRLKVDKISQEELYEYWSQITDQSFDSRLQIFFDMVDKNEDGRIGEEEVKEIIMLSASANKLSRLKEQAEEYAALIMEELDPERLGYIELWQLETLLLQKDTYLNYSQALSYTSQALSQNLQGLRKRSPIRRMSTKLVYSLQENWKRIWVLVLWILIMIGLFLWKFYQYKQKSAFQVMGYCLLTAKGAAETLKFNMALILLPVCRNTITFLRSTKLSCFVPFDDNINFHKTVAAAIVTGIILHAGNHLVCDFPKLIHANSTNYQKYLVNDFGPSQPQYIDLVKGVEGVTGIVMVILMAIAFTLATRWFRRSLIKLPKPFDRLTGFNAFWYSHHLLIIVYIVLIIHGTFLYLVHNWYSKTTWMYIAVPVLLYAGERTLRFFRSGLYSVRLLKVAIYPGNVLTLQMSKPPQFRYKSGQYMFVQCPAVSPFEWHPFSITSAPGDDYLSIHIRQLGDWTQELKRVFSEACEQPEAGKSGLLRADENTKTSLPKLLIDGPYGAPAQDYRKYDVLLLVGLGIGATPFISILKDLLKNIVAMEEQADLVSDFSGNSDMSAATSEQPALNKISPKKRKSTLKTTNAYFYWVTREQGSFDWFKGVMNEVAELDQRGVIEMHNYLTSVYEEGDARSALITMVQALNHAKNGVDIVSGTSVRTHFARPNWRKVFSKTLTKHANARIGVFYCGAPILAKELSQLCKEFNQKGTTKFEFHKEHF

SEQ ID NO: 602 - protein, 394 aa, Solanum lycopersicum
METGVTCCARVTSLLPNVSSQQYSTSIATSRSISPSFNSRSLKSSSLFGESLRVAPKSSLKVSRTKNSSLVTKCEIGDSLEEFLSKSTSDKGLIRLMMCMGEALRTIAFKVRTASCGGTACVNSFGDEQLAVDMLADKLLFEALTYSHFCKYACSEEVPELQDMGGPAEGGFSVAFDPLDGSSIVDTNFTVGTIFGVWPGDKLTGITGREQVAAAMGIFGPRTTYVLALKDVPGTHEFLLLDEGKWQHVKDTTEIGEGKMFSPGNLRATFDNPDYAKLIEYYVKEKYTLRYTGGMVPDVNQIIVKEKGIFTNVTSPTAKAKLRLLFEVAPLGFLIEKAGGYSSDGKQSVLDKVIVNLDDRTQVAYGSKNEIIRFEETLYGSSRLKAGAPVGAAV

SEQ ID NO: 603 - protein, 885 aa, Solanum lycopersicum
MDLVASCKDKLAYFRIKELKDVLNQLGLSKQGKKQDLVDRILATLSDERASGLFPKRNSVGKEDVAKLVDDIYRKMQVSGATGATGATDLASKSQVVSDTSNVKLKEEIEDTYHMKIRCVCTSSLQTETMIQCEDRRCHTWQHIRCVVIPEKPMEGGDPPIPPTTFYCEVCRLVRADPFWVTMGHPLYPAKLAITSVPADGTNPVQSIEKTFQITRADRDLLAKQEYDLQAWCMLLNDKVQFRMQWPQYADLQVNGVPVRAINRPGSQLLGANGRDDGPIITPCTRDGINKVTLTGCDARVFCLGVRLVKRRTVQQVLSMIPKVSDGEKFEDALARVRRCVGGGTATENADSDSDLEVVADCIPVNLRCPMSGSRMKIAGRFKPCIHMGCFDLDVFVEMNQRSRKWQCPICLKNYSLEHVIIDPYFNRITSQMRSCGEDVTEIEVKPDGSWRAKTESDRRSLGDLGRWHLPDGSLSESPDIESKPKPEILKQVKQEGGSDGNGLKVGLKKNRDGLWEISKPEDQTFSSGNRLRENFGQDVIPMSSSATGSGKEGEDRSVNQDGNGNLEFSNNAFDLEAISLNIDPPYGFGNGNPSIPAGDAEVIVLSDSDEENEPIIPSGAVFNNNHSDAPVVSFPAQPLGIPDSFHDSALVNGGNSCLGLFNSNDDEFGMNLWSLPSGTQGGPGFQLFSSDADVSGSLVDVQHESINCTSSMSGYGLGAESGIGSASLLPETYTDRPNADINDSLVDNPLGFSGNDPSLQIFLPTRPSITSVEAARDQPDVSNGVGTEDWISLRLGGDGGVPGDTAVANGLSSGQQVQTKDTALDSLADTGSDAPVCAASLLIGMNDSRSTKSSRERSDSPFTFPRQRRSVRPRLYLSIDSDSE

SEQ ID NO: 604 - protein, 492 aa, Solanum lycopersicum
MTCDSEIKLFGKILPVVVSGVGRGLSGSDGVIYDGNRNGSDLDRCLEGSKASSVEKDEGSEYEKQEAEKDNITGELSEAKSEEGDQNQMIEESENPKTPSESESSPKSSTEEDPQAVKSSKTENEPTNVTNSEQNNLKKPDKILPCPRCNSLDTKFCYYNNNNVNQPRHFCRSCQRYWTAGGTMRNLPVGAGRRKNKNLASQYRNISIPEGLLAAGIESPNGLIHHPLFKPNGTILSFGPDLPLCEPMASALNQAEKRVSTGIQNGSHKSEVKNSSCKGGDSGDECCRGINIPTPNMMVEEGKGEPHKAVMHSINGIPSPVPCLHGVPWPFPWNAAVPVSAICPIPFPMPFFPTPYWNCSVPPWSNPWLSPPLRAANEKTSGSDPTSSLGKHSREGDLLKPSNPGGKEQSEQKYSEGSILVPKTLRIDDPDEAAKSSIWSTLGIKYDSTNRGEFFKALQPKSNDKHNKANTFPVLHTNPAALSRSITFQQGA

SEQ ID NO: 605 - protein, 438 aa, Solanum lycopersicum
MLTVKRVPTLVSNYQEDVLEGNVMGCGRKCLGKCCMPVSVLPLYAFKNDDNEPIENDVQTLPEEECQMSFLNDLLLGLWEERMSQGLFRYDVTTCETKVIPGRCGFIAQLNEGRHLKKRPTEFCIDKVLQPFDENKFNFTKVGQEEVLFRFEPSTDYKAHYFSGMRVNSGISPSIVAINVSPIEYGHVLLIPRVLDCLPQRIDRDSFAIALHFAREVADPFFRVGYNSLGAFATINHLHFQAYYLSVPFPVEKAPIQKILARKGLGGAGVIVSKLLNYPVRGFAFEGGNGSTARDLSDAVVNSCISLQNKNIPFNILIAQCGKKIFLLPQCYAEKQALGVVDQELLDTQVNPAVWEISGHIVLKRTKDYNDASEEYAWKLLSEVSISEERFEEVKGYISEAADLQADEDENINPEKEIPDSPGPQVASHIPPDCLVLQ

SEQ ID NO: 606 - protein, 323 aa, Solanum lycopersicum
MIGMMNSAQMCKQVRWQNLLQLQNFLQKDKVVVVMGVTGAGKSKLSIDLATQFDGEIINSDKIQVYKGLDIATNKITEEERCGVPHHCLGVIDPYKEFTTKNFCNMASFTVNSITNRGKLPIIVGGSNSFIEAFVHNSNSYNFSTRYDFCFLWVDASMNVLNSFLYERVDKMVDQGMVDEVRQIFNPKNMDYTKGIRKAIGVPEFDSYFRAELSNSVDRQTLERMLEEAITEIKINNCILASKQLEKIKRLISVKGWKIHRLDASEVFKKQRIAEEKEAEEIWKNMVMGQSRKIVHKFLYENYRNSMVYKTDGTAIMAAASHY

SEQ ID NO: 607 - protein, 535 aa, Solanum lycopersicum
MAASSFSFPTSSSSFMTTSFTDLLASDDYPTKGLADRIAERTGSGVPKFKSLPPPSLPLSPPPFSPSSYFAIPPGLSPTELLDSPVLLSSSNLLPSPTTGSFPSRAFNWKSSSHQDVKQEDKNYSDFSFQPQVGTAASSISQSQTNHVPLGQQAWNCQEPTKQNDQNANGRSEFNTVQNFMQNNNDQNNSGNQYNQSIREQKRSDDGYNWRKYGQKQVKGSENPRSYYKCTYPNCPTKKKVERSLDGQITEIVYKGNHNHPKPQSTRRSSSSTASSAFQSYNTQTNEIPDHQSYGSNGQMDSVATPENSSISFGDDDHEHTSQKSSRSRGDDLDEEEPDSKRWKRENESEGVSALGGSRTVREPRVVVQTTSDIDILDDGYRWRKYGQKVVKGNPNPRSYYKCTSTGCPVRKHVERASQDIRSVITTYEGKHNHDVPAARGSGNHSINRPMAPTIRPTVTSHQSNYQVPLQSIRPQQSEMGAPFTLEMLQKPNNYGFSGYANSGDSYENQVQDNNVFSRTKDEPRDDLFMESLLC

SEQ ID NO: 608 - protein, 130 aa, Solanum lycopersicum
MAQYGNQDQMRKTDEYGNHVQETGVYQGTGTGGMMGGTGTGGMMGGTGGEYGTQGMGTGTHHHEGQQQLRRSDSSSSSEDDGEGGRRKKGLKEKIMEKMPGQHEGEYGQTTGEEKKGMMDKIKDKIPGMH

SEQ ID NO: 609 - protein, 373 aa, Solanum lycopersicum
MASIIGVSSSPFPTQTSHLLPSRSNSISSLVQLKRDSVRRLLLLRVNCSSRQVGDAETESESKVVLPDTPADTGISAYNWCAALGGIGFLETSYLTFLKLTNSAAFCPVGDGASCGDILNSSYSAVFGVPLPLIGMVAYGVVAILGIQLGQKSRPLGTGEANGRLVLLGTTTSMAAASAYFLYILSTKFTGEFCPYCLASVLLSFSLFISSMKGLGFQEVQKDVGIQLLIVLLVVSTLNNSYSDSQPTNTGSALAEMEYFTAEITSESTPFAISLAKHLHSIGAKMYGAFWCSHCQEQKQMFGREAAKLLDYVECFPYGLKRGISMINACQEAKLEGFPTWVINGEVLSGEKKLSELAALSGFDMKEELTEAK

SEQ ID NO: 610 - protein, 378 aa, Solanum lycopersicum
MAIDCMITNGKSPMLDEKKQFIFDASHMKRESNIPTQFIWPDHEKPCALVQQLHVPLIDLRGFLSGDPDAAQQASELVGEACRGHGFFLVVNHGVDANLISNAHRYMDTFFELPLLEKQKAQRKIGEHCGYASSFTGRFSSKLPWKETLSFRYSAKKESSHIVEEYFQSTLGESFNHLGNVYQEYCNSMNTLSLGIMELLGMSLGVEKSHFKEFFEENDSIMRLNYYPPCQKPELALGTGPHCDPTSLTILHQDCVGGLQVFVDDEWRSISPNFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWLHDQHNTTTQA

SEQ ID NO: 611 - protein, 485 aa, Solanum lycopersicum
MGFEIAKTNSILSKLATNEEHGENSPYFDGWKAYDSDPFHPLKNPNGVIQMGLAENQLCLDLIEDWIKRNPKGSICSEGIKSFKAIANFQDYHGLPEFRKAIAKFMEKTRGGRVRFDPERVVMAGGATGANETIIFCLADPGDAFLVPSPYYPAFNRDLRWRTGVQLIPIHCESSNNFKITSKAVKEAYENAQKSNIKVKGLILTNPSNPLGTTLDKDTLKSVLSFTNQHNIHLVCDEIYAATVFDTPQFVSIAEILDEQEMTYCNKDLVHIVYSLSKDMGLPGFRVGIIYSFNDDVVNCARKMSSFGLVSTQTQYFLAAMLSDEKFVDNFLRESAMRLGKRHKHFTNGLEVVGIKCLKNNAGLFCWMDLRPLLRESTFDSEMSLWRVIINDVKLNVSPGSSFECQEPGWFRVCFANMDDGTVDIALARIRRFVGVEKSGDKSSSMEKKQQWKKNNLRLSFSKRMYDESVLSPLSSPIPPSPLVR

SEQ ID NO: 612 - protein, 469 aa, Solanum lycopersicum
MKLLSEKATCNSHGQDSSYFLGWQEYEKNPYDEIQNPKGIIQMGLAENQLSFDLLESWLAQNPDAAGFKRNGESIFRELALFQDYHGLPAFKNAMTKFMSEIRGNRVSFDSNNLVLTAGATSANETLMFCLANQGDAFLLPTPYYPGFDRDLKWRTGAEIVPIHCSSSNGFRITESALEEAYLDAKKRNLKVKGVLVTNPSNPLGTTLNRNELELLLTFIDEKGIHLISDEIYSGTVFNSPGFVSVMEVLIEKNYMKTRVWERVHIVYSLSKDLGLPGFRIGAIYSNDEMVVSAATKMSSFGLVSSQTQYLLSCMLSDKKFTKKYISENQKRLKKRHAMLVKGLKSAGINCLESNAGLFCWVDMRHLLSSNNFDAEMDLWKKIVYDVGLNISPGSSCHCTEPGWFRVCFANMSEDTLDLAMRRIKDFVESTAPNATNHQNQQQSNANSKKKSFSKWVFRLSFNDRQRER

SEQ ID NO: 613 - protein, 476 aa, Solanum lycopersicum
MDLETSEISNYKSSVVLSKLASNEQHGENSPYFDGWKAYDNDPFHLVNNLNGVIQMGLAENQLSVDLIEEWIKRNPKASICTNDGIESFRRIANFQDYHGLPEFTNAIAKFMEKTRGGKVKFDAKRVVMAGGATGANETLILCLADPGDAFLVPTPYYPGFNRDLRWRSGVQLLPISCKSCNNFKITIEAIEEAYEKGQQANVKIKGLILTNPCNPLGTILDRDTLKKISTFTNEHNIHLVCDEIYAATVFNSPKFVSIAEIINEDNCINKDLVHIVSSLSKDLGFPGFRVGIVYSFNDDVVNCARKMSSFGLVSTQTQHLLAFMLSDDEFVEEFLIESAKRLRERYEKFTRGLEEIGIKCLESNAGVYCWMDLRSLLKEATLDAEMSLWKLIINEVKLNVSPGSSFNCSEVGWFRVCFANIDDQTMEIALARIRMFMDAYNNVNKNGVMKNKHNGRGTTYDLTPQMGSTMKMLLA

SEQ ID NO: 614 - protein, 249 aa, Solanum lycopersicum
MDFQSDLTREISPQRKLGRGKIEIKRIENTTNRQVTFCKRRNGLLKKAYELSVLCDAEVALVVFSNRGRLYEYANNSVKATIERYKKACSDSSNTGSVSEANAQYYQQEASKLRAQIGNLMNQNRNMMGEALAGMKLKELKNLEQRIEKGISKIRSKKNELLFAEIEYMQKRQEVDLHNNNQYLRAKIAETERAQHQHQQMNLMPGSSSNYHELVPPPQQFDTRNYLQVNGLQTNNHYPRQDQPPIQLV

SEQ ID NO: 615 - protein, 1152 aa, Solanum lycopersicum
MARKRRSELPGSGESSGSQETVGGQGRGQYPPQQQQEGGYQGGGQGRGMRPPPQHQQQLGGYQGGGQGRGQRPPQQHQHEGGYQGGGQGRGMRPPPQQSQQEGGYQGGGQGRGQRPPQQLQQEGGYQGGGRGWRPQQGGYGGRGSGGAPRGGMAPQQPYGGQAEYYQQGRGTQQHQQRGGGPLQQHGGIGGRGAPSGGPSRPPIPELHQATTQTQHQAVMTTQPITCGRPADTSMEVGSSSEPPEMSALQVTQQFQQLAVQPEAAATHTIPPVSSKSLRFPLRPGKGKFGQSCIVKANHFFAELPDKDLHQYDVTITPEVSSRGVNRAVMAQLVLLYQESHLGKRLPAYDGRKSLYTAGPLPFVQKEFKITLTDDEDGPGGARRDREFKVVIKFASRADLHHLGMFLEGRQADAPQEALQVLDIVLRELPTSKYCPVGRSFYSPNLGRRQPLGEGLESWRGFYQSIRPTQMGLSLNIDMSSTSFIEPLLVVDFVAQLLNRDVSSRPLSDADRVKIKKALRGVKVEVTHRGNMRRKYRIANLTSQATRELTFPVDEKGTLKSVIEYFRETYGFVIQHTQWPCLQVGNQQRPNYLPMEVCKIVEGQRYSKRLNEKQITALLKVTCQRPQERERDILETVKHNAYAEDKYAKEFGIKISDKLAQVEARILPPPWLKYHDNGREKDCLPQVGQWNMMNKKMVNGGTVANWICINFSRNVQDTVAHGFCSELAQMCGISGMNFNPNPVLPPVSARPDQVERVLKTRFHDAMTKLQPLSKELDLLVAILPDNNGSLYGDLKRICETDLGVVSQCCLTKHVFKMSKQYLANVALKINVKVGGRNTVLVDAISRRIPLVSDRPTIIFGADVTHPHPGEDSSPSIAAVVASQDWPEITKYAGLVSAQAHRQELIQDLYTTRQDPVKGTVSGGMIKDLLISFRRATGQKPQRIIFYRDGVSEGQFYQVLLYELDAIRKACASLEPNYQPPVTFVVVQKRHHTRLFANNHRDRNAVDRSGNIIPGTVVDSKICHPTEFDFYLCSHAGIQGTSRPAHYHVLWDENKFSADGLQSLTNNLCYTYARCTRSVSIVPPAYYAHLAAFRARFYMEPETSDGGSVTSGAAGRGVGAGAAGKNTRAPGAGSAVRPLPALKDNVKRVMFYC

SEQ ID NO: 616 - protein, 1000 aa, Solanum lycopersicum
MEHTENSNKCNSKSTTAKICPNNNNNNNNNHYIAFGFHHNTNNNQYHETYPPLLPLPPLLPPLQLPFPQNHNFRSRTHLHKPSFNQNHPFLATPSDFKIQQISASKVLQRQNDVSKQKYGRRVRAAATTTESVVVARRPDSGGVEGPVISLLANHFLVQFDPSQRIFHYDVEISPHPSKDIARLIKKKLVEDHSVMLSGALPVYDGGRTIYSPIEFQNNKIEFYISLPIPSSGSNKSGEIVKLQKEGQQIKLFRVNIKLISKFDGKELNSYLNKEGDDGGSPLPQEYLHALDVVLRESPTEKCITAGRSFYSSCMGGQKDIGGGAVALRGFFQSLRPTQQGLALNVDFSVTAFHESIGVITYLEKRLDFLHDISHRKTRGLTNEEKKEVEKALKNIRVFVCHRETVQRYRIYSLTEEVTENLCFQDRDGKILRIVSYFKDHYNYDILYRNLPCLQISRSKPCYLPMELCMICEGQKFLGKLSDDQTARILKMGCQRPRERKAIIDRVVTGLVGPTSGNHASDFKLQISKEMTQLYGRILQPPKLKLGDRGQVRNLIPSRHDRQWNFLDSHVFESTRVERWALMSFGGTSDQKSHVPKFINQLCQRCEQLGIFLNKNTVLNPQFEPLHLLNNVKNLESKLNKLHRASFNNLQLVICVMERKHKGYADLKRIAETSIGIVTQCCLYPNLGKISSQFLANLALKINAKVGGCTVALYNSLPSQIPRLFKHDGPVIFMGADVTHPHPLDDFSPSVAAVVGSVNWPAANKYVSRMRSQTHRQEIIQDLSAMVGEIIDDFYEELLKLPERIIFFRDGVSETQFLKVLKEELQAIRLACSRFPGYKPPITFVVVQKRHHTRLFPCELDPSTTKNTLFNENILPGTVVDTVITHPSEFDFYLCSHWGVKGTSRPIHYHVLWDENQFTSDELQKLVYNLCYTFVRCTKPISLVPPVYYAHLAAYRGRLYLERSDLSTLTRSSNISRAAPPKTTPLPKLTENIKRLMFYC

SEQ ID NO: 617 - protein, 699 aa, Solanum lycopersicum
MKEVLEKCVDSQLWHACAGGMVQIPPVNSKVYYFPQGHAEHTLMNVDFSALPRSPALILCRVAAVKFLADPETDEVYAKIRVVPVGNKGNDFDDDDDILGSNESGTAEKPNSFAKTLTQSDANNGGGFSVPRYCAETIFPRLDYTADPPVQTVTAKDVHGESWKFRHIYRGTPRRHLLTTGWSSFVNQKKLVAGDSIVFLRAENGELCVGIRRAKRGGIGGPEAPSGWNSGAGNYGGFSAFLREEMSKNGNLTSPTRSLRGKGRVRPESVVEAAYLASSGQPFEVVYYPRANTPEFCVRASSVNAAMRIQWCSGMRFKMAFETEDSSRISWFMGTISSIQLADPIRWPNSPWRLLQVAWDEPDLLQNVKHVSPWLVELVSNMPVIHLSPFSPPRKKLRLPPDFSLDSQFQLPSFSGNPLRSSSPFCCLSDNITAGIQGARHAQFGVPLLDLHLSNKLPSGLLPPSFQRVAANSQLPNVINKCQNDRNDNISCLLTMGTSSKTLDKNDSVNTPRFLLFGQPILTEQQISNGCSVSAPQVVQTGKDLGRIQPINEKHPSEQKGSIQDNLSSATFFWNRGYHAAELGVLNTGHCKVFLESEDVGRTLDLSVMGSYEELYKRLANMFGLERPDMLTRVLYHDATGAVKHTGDEPFSDFVKSAKRLTILMNSSSNIKRKWLTGLATAERGLDSSNQAGPLSIFA

SEQ ID NO: 618 - protein, 846 aa, Solanum lycopersicum
MAASEVSIQGYSEPSDGSRPVSETGRSSSGVGIVDADTALYTELWRSCAGPLVTVPREGELVYYFPQGHIEQVEASTNQVADQQMPLYNLPSKILCRVVNVLLKAEPDTDEVYAQVTLMPEPNQDENAVKKEPMRPPPPRFHVHSFCKTLTASDTSTHGGFSVLRRHADECLPQLDMSRQPPTQELVAKDLHGNEWRFRHIFRGQPRRHLLQSGWSVFVSSKRLVAGDAFIFLRGENGELRVGVRRAMRQQGNAPSSVISSHSMHLGVLATAWHAIQTKTMFTVYYKPRTSPAEFIVPYDHYMESVKNNYSIGMRFKMRFEGEEAPEQRFTGTIVGIEDADPQRWLESKWRCLKVRWDENSSIPRPDRVSPWKIEPALSPPALNVPPVARPKRPRSSILPTSPDSSVLTREGSSRATADHSQASGFPRVLQGQELSTFRGGFAEINETDLSEKPMIWQTSVNDEKNDIHSASKRYLPDKWLPLGRPESSLTDLLSGFGSSHGFCLPSADQAAFGARLVKQQTQDQEKDFSLLGKPWSLLSSGLSLNLMDSGSKAPGIGGDTPYQMRGDARYSGYGEFSVLPGHRVANQQGSWIMPQPVSPYMQLSSHSREMMHKPSVVKQPEAVKPKEGNYKLFGIPLTSNVCTDAVMMRKSSLIDPASDMNIGIHPHQSLATDSDQRSEQSKGSKVDDGVAANDHDKQFHTFHLAARDKDGKGHSSSTRSCTKVHKQGTALGRSVDLAKFNNYDELIAELDQLFDFNGELKARSKSWLVVYTDDEGDMMLVGDDPWQEFCGMVRKIFIYTKEEVQRMNPGTLNSKGEDTSSVAEGSDAKEVKNLQLPSESGQAES

SEQ ID NO: 619 - protein, 747 aa, Solanum lycopersicum
MMCGLIDLNTVDNDDAGEETTAPVSLDSPASSSAASGSSDLTSSTTPAVASVCMELWHACAGPLISLPKKGSAVVYLPQGHLEHLSEYPSIACNLPPHVFCRVVDVKLQADAATDEVYAQVSLVPDNQQIEQKWKDGDIDADIEEEEIEGAGKSITPHMFCKTLTASDTSTHGGFSVPRRAAEDCFAPLDYRQQRPSQELVAKDLHGIEWKFRHIYRGQPRRHLLTTGWSAFVNKKKLVSGDAVLFLRTGDGELRLGVRRAAQAKTCSSYLAPCSKPLNVSGIVDAVNVISSRNAFNICYNPRDSSSDFIVPYHKFSKTLAHPFSAGMRFKMRVETEDAAEQRFTGLVVGVSNVDPVRWPGSKWRCLLVRWDDLDVSRHNRVSPWEIEPSGSAPVPSSLVMPSAKRTRVGFPISKADFPIPREGIAVSDFGEPSRFQKVLQGQEILRMHAPYGGLDARSPRPAGTRCFPGFPSSGISRMGNSIRPLFGDTDKSHESIGFSESLRFNKVLQGQEIFTSPPYGRAQAGIQMQEKSRTGIFVGIQVPNHGNRWPAPNQDNNTPCKPINPVSASSPPSALNFQHPSPPASKFQAMFNHKHDLVNQASLDLSENCCRYPYLSSGSHTEDISQKEGTQGISSFGFLKEQKQTGLSYLSPGTQSSFKGNQNLVSTCKTGCRIFGFPLTESKISATRADTPSEAVYSHGLETTFLPSSDGKLQPGPPLMTNVVGTNFTKVNDLYAARDVLLDIAL

SEQ ID NO: 620 - protein, 811 aa, Solanum lycopersicum
MEIDLNHALVSEVEKNVCCNEECDKGGGGGCVNCSLYTSTTSSCSSNVSSSSSLALTSIYKELWHACAGPLTSLPKKGNVVVYFPQGHMEEAVSAFPFSPVKIDLPTFGLQPQIFCRVEDVQLLANKENDEVYTQLTLLPLPESMAISLEGKEHEDSGTDEEGNGVNPGKSASHMFCKTLTASDTTTHGGFSVPRRAAEDCFPPLDYKEQRPSQELIAKDLHGVEWKFRHIYRGQPRRHLLTTGWSIFVSQKNLVSGDAVLFLRGEGGNLRLGIRRAARPRNGLPESIIKSQYSGPDVLSSVATALSAKSTFHVFYSPRASHADFVVPYQKYVKAINSRIPVGTRFKMKFDLDDSPERRYSGVVTGISDMDPFRWPNSKWRCLMVRWDEDIMSNHQERVSPWEIDSSVSLPPLSIQSSPRLKKLRTSQQAPSVLDSHFAGGSALLDFEESIRSSKVLQGQENLGLISPPYGCDKPVRPLDFELQRVARHNLMPNGVENIIVGDFVKTQPPTTYTGFLESNRFPKVLQGQEICSLRSLTGKGDVNFGAWGKPEFGCNVFGTYQRPRANFYPLASEGARNVFLPYNAMYRAGQDPVVPSYSTNFQRENPTLNQNSIQNVVRREEVGMPKFVNEQRPPEMSKVSIPENHFKNENDDSFNAQAPCKLFGFSLTKEPSTPSSQSSGKRSCTKVHKQGSLVGRAIDLSRLNGYDDLLVELERLFNMEDLLRDPNKGWRILYTDSENDMMVVGDDPWHEFCEVVSKIHIYTQEEVEKMTIEGISDDTQSCLEEAPAIMDVSKSSSVGQPDSSPTVIRI

SEQ ID NO: 621 - protein, 930 aa, Solanum lycopersicum
MGSVEEKNKPGSLVSGAHTLLEEMKLLKEMQDHTGGGRKLISSELWHACAGPLVTLPQVGSLVYYFPQGHSEQVAVSTNRTATSQIPNYPNLASQLLCQVHNVTLHADKETDEIYAQMSLQPVNSEKDVFPIPDFGLKPNKHPTEFFCKTLTASDTSTHGGFSVPRRAAEKLFPPLDYSMQPPTQELVVRDLHDNTWTFRHIYRGQPKRHLLTTGWSMFVGAKRLRAGDSVLFIRDEKSQLLLGVRRANRQQTSLPSSVLSADSMHIGVLAAAAHAAANRSTFTIFYNPRACPSEFVIPLAKFRKSVYNTQLSVGMRFGMMFETEESGKRRYMGTISGISDLDPLRWPGSKWRCLQVEWDEPGCGDKQNRVSPWEVETPESLFIFPSLTAGLKRPYQSTFLGAQTEWDSLMQHRPFMRVPENVYGDLQSSSISNLWSEQLMKMLIRPPPGLTGLQCGVPTVQDIKVALPQEARNVVQPAGNQKPELITVEATPAQSETNSEVALNQPVGVVNSISSQQATLQAKSKPPEKVETDIIGKNSEPRKETSNSSVKLDQFQCNEDKVAIKPASPHDLPTDASVTASHHNSFSQLQASPWLTPHNPQIDSAASNNTLQCPTNNEWNMSSLQSAAGLLKYPVSTSTLTKHDNSFMLPDTIGHGLAPIGQDLWDHQLNDVKCFSQTNLQVPLDITNMQFLPDSYGFKDLSEESHNQSDIYSCLNFDSNSGSTVIDNSVSSTVLDEFCNLKHTDFQNPSDFLLGNISSSQDVQSQITSASLADSQNFSVQEFADNSGGASSSNVNFDECNLLQNSSWQQVAPRVRTYTKIQKTGSVGRSIDVSGFKNYEELRSEIERMFGLEGLLNDTRGSSWKLVYVDFENDVLLVGDDPWEEFVGCVRCIRILSPTEVQQMGEEGMQLLNSAGLQSINGSTSEFPN

SEQ ID NO: 622 - protein, 881 aa, Solanum lycopersicum
MRLSSAGFNPQPEMAAGEKKSLNSELWHACAGPLVSLPHVGTRVVYFPQGHSEQVAASTNKEINGHIPSYPGLPPQLICQLHNVTMDADVETDEVYAQMTLQPLTPQEQKDVCLLPAELGTLSKQPSNYFCKTLTASDTSTHGGFSVPRRAAEKVFPPLDYSQQPPVQELIGKDLHGNEWKFRHIFRGQPKRHLLTTGWSVFVSAKRLVAGDSVIFIWNENNQLLLGIRRANRPQTVLPSSVLSSDSMHIGLLAAAAHAAATNSRFTIFFNPRACPSEFVIPLAKYAKAVYHTRVSVGMRFQMLFETEESSIRRYMGTITGIGDLDPVRWPNSHWQSVKVGWDESTAGERQPRVSLWEIEPLTTFPMYPSPFSLRLKRPWPPGLPSFPGLSNGDMTMNSQLPWLHGGMGDQGIQSLNFQGFGVTPFMQPRFDASMLGLQPDILQAMAALDSSKLANQPLMQFQHIPSTSASSIQSQLLHPSNLQHTFLQGLPENQLISQAQMLQQQLQCHQSYNTQQQQLQRQRLYHDQQLQEPHQVQRQDQQQTKAQLCSATQSQLSHLQVLGSTGSQQTFSDLVGNHINTSNNSSTMQSLLSSFSRNGASTSLNMPETNSLVSPSSSSKRIALESQIPSQAPYMVTQAEVLTVPNTKVSDFSTLFSPNPGRQVLDYQAVAVSQNNALFGVNGMSNLKGNSPENGSLPVPYATSTFTSTVGGEYPVNSDMTTSSCVDESGVLQSSENVDQANSLTETFVKVYKSESFGRSLDISKFSSYNELRSELARMFGLEGLLEDPERSGWQLVFVDRENDVLLLGDDPWHEFVNSVWYIKILSPLEVQQMGKQGLDLPSAGKTQRITSNGNGCDDSMNRNHSCNIMNGIPLGSLEY

SEQ ID NO: 623 - protein, 644 aa, Solanum lycopersicum
MNSPGKKDALYHELWQLCAGPVVDVPREGERVYYFPQGHMEQLVASINQEMDQRVPSFNLKSKVLCRVINSHFLAEEDNDEVYVQITLMPEAPHVPEPTTPDPLIPQDVKPRFHSFCKVLTASDTSTHGGFSVLRKHANECLPPLDLNQQTPTQELIAKDLHDVEWRFKHIFRGQPRRHLLTTGWSTFVSSKKLVAGDSFVFLRGNNGQLRVGVKRLVRQQSSMPSSVMSSQSMHLGVLATASHAVTTQTMFVVYYKPRTTQFIVGVNKYLEALKHEYAVGMRFKMQFEAEGNPDRRFMGTIVGIDDLSSQWKNSAWRSLKVRWDEPAAIARPDRVSPWEIKPYVCSIPNVLVPPTAEKNKRHRLHSEIKISEQPSSSNASAVWNPSLRSPQFNTFGINSSTNCALASLTESGWQLPHLNTSGMLVDEPEDGRSAPTWCGFPCVLAPQFGQGTNQPIVIPTDGRKCDTKKTCRLFGIDLKSSSISTTEARLQLQPAGISCVFAERAPPNTVPAGDSDQKSELSVDFKDQMQGHLRLPLKEVQSKQSCSTRSRTKVQMQGVAVGRAVDLTILKGYDELTKELEEMFEIQGELQSRQKWGILFTDDEGDTMLMGDYPWQDFCNVVRKIFICSSQDMKKLTLSRADS

SEQ ID NO: 624 - protein, 322 aa, Solanum lycopersicum
MADSDNNNDIVTDFFPYYRLYKDGRVERFYELGGVHQVPPSLEDPATGVSSKDVSISAHVSARLYLPKNTAPNQKLPVLVYYHGGGLVLGSAFFKTEHCYLNHLVSESNCIAISVDYRLAPEHDIHTIYQDCWDALQWVASHSVSDTINKEPWIENHSNFNRLFVGGDSAGGNIVYNMIMRAGREKLIGDVKILGAILGFPYLMIPSIENYDKGMAYKLWNMICPLSERGNDSPMVNPVSKKCPSLSKLGCSRLFVCTGEKDELVPGEVAIKFAEAVKKSGWEGEIESIIVEGEGHCFHCENPQAEKSKDLIKRIVSFIQRD

SEQ ID NO: 625 - skipped

SEQ ID NO: 626 - protein, 580 aa, Solanum lycopersicum
MAMSLPHQIGALSGTSLTAETGGVSCEVPAKGSSATSAMWRTPMTNLKVSVQKTGNEIDRVSPSPSPPMSPMMGGGMRPDLSVACQALMEAQVEEVVEREYKVRNSSEKEKGVPVFVMMPLDSVKTDHTVNRKKAMNASLQALKSAGVEGIMMDVWWGLVERDAPGEYNWGGYAELMEMAKKHGLKVQAVMSFHQCGGNVGDSCTIPLPRWVVEEMEKDPDLAYTDQWGRRNFEYVSLGCDTLPVLKGRTPVQCYSDFMRGFRDRFENLLGDTIVEIQVGMGPAGELRYPSYPEKDGIWKFPGIGAFQCYDKYMIGSLQGAAEAFGKPEWGHTGPTDAGEYNNWPEDTNFFKKEGGGWDSQYGEFFLTWYSQMLLNHGERILQSSKAIFEDKGVKISVKIAGIHWHYGTRSHAPELTAGYYNTRNRDGYLPIAQMLARHGAVFNFTCVEMRDHEQPQDAQCAPEKLVRQVALATQEAQVPLAGENALPRYDDYAHEQILQASSLSINDQSGDREMSAFTYLRMNPDLFHPDNWRRFVAFVKKMKEGKDANKCREQVEREAEHFVHITQPLVQEAAVALMH

SEQ ID NO: 627 - protein, 315 aa, Solanum lycopersicum
MGRAPCCDKANVKRGPWSPEEDAKLKDFIHKFGTAGNWIALPQKAGLRRCGKSCRLRWLNYLRPNIKHGDFSDDEDRVICNLYANIGSRWSIIAAQLPGRTDNDIKNYWNTKLKKKLMGLIIPNNNSSSSYNNNNNNYQKKLPYFPSTSLHQAQQNLGPFITGPEQPIIIPAAQQNNLFTNNNNNLMMIANNLQNYPNFGATNYNLQNYPNFGEVASCSSSDGSQMSFGTNKDIINIKREEIMSFGGHHDGAIYEEINNNQQFNFGYFGNTMQEIATSCCTNGNSGSTTNSSNNFLLYNNDENCNKSNEIGMFYY

SEQ ID NO: 628 - protein, 663 aa, Solanum lycopersicum
MDLQFVSLPPNSKTKAKMQAKACHNINNIPPKLLPPAKLPSTVAMSPSQLTLPSHVARAITITTSPTHEVYTPEIDDTVTAYWDYQFLFVSQRSEATEPVSLRVVEGSIPSDFPSGTYYLTGPGLFADDHGSTVHPLDGHGYLRTFEIDGSTGQVKFMARYIETEAQTEERDPVSGKWRFTHRGPFSVLKGGKMVGNTKVMKNVANTSVLQWGGRLFCLWEGGDPYEIDSKTLNTLGKFELIKNSDQVLEDKKISHSDFLDVAAQLLKPILYGVFKMSPKRLLSHYKIDTRRNRLLIMSCNAEDMLLPRSNFTFYEFDSNFQLLQSQEFEIPDHLMIHDWAFTDTHYILFGNRIKLDIPGSMTAVCGLSPMISALSVNPSKPTSPIYLLPRFRNNNVERDWRKPIEAPSQMWVLHVGNAFEEIDEQNGNLNIQIQASGCSYQWFNFQKMFGYDWQSGKLDPSMMNVEEGEEKLLPHLVQVCINLDKKGNCTKCSVNDLNPEWNKAADFPAMNPEFSGRKNRYIYAATCTGSRQALPHFPFDAVVKLNAVDKSVQKWSAGRRRFIGEPVFIPRGTNKEDDGYLLVVEYAVSTQRCYLVILDAQKIGEKNEVVARLEVPRHLNFPLGFHGFWAPTNSSLANLQKIESKCKNSWSMMKDNMVKLGQ

SEQ ID NO: 629 - protein, 501 aa, Solanum lycopersicum
MACSKNIWVIVIFFLCILAGPIIAQDYNDSLGKAILFFEGQRSGKLPVSQRVKWRGDSALIDGIIEHVNLIGGYYDAGDNVKFGWPMAYSLTLLSWAAIEYQTQISSTNQLVHLQNAIRWGTNFLIRAHTSSTTLYTQVGDGNADHQCWERPEDMDTPRTLYKITSNSPGSEVAADVAAAFAAASIVFKNIDSNYSTKLLKRSRSLFAFADKYRGSYQASCPFYCSYSGYKDELLWAAAWLYKAGGGNNYLNYASINQGWSQVASEFSWDDKFAGAQTLLAKEYLNGKSNLEKFKKDADSFICGLMPESSSIQIKTTPGGLLYYRDSSNLQYVNGATMVLFMYTKVLEAAGIGGVTCGSVNFSTSKIKAFAKLQVDYILGNNPLKMSYMVGFGNKYPTKLHHRASSLPSIYNHPTRVGCNDGYSSWYNSNNPNPNTHVGAIVGGPNSGDQFIDSRSDYSHSEPTTYMNAAFIGSVAALIDQTKEGEHYGEINSQFNKTGFM

SEQ ID NO: 630 - protein, 489 aa, Solanum lycopersicum
MAPKYTSIIFLFLLFNSFSCSFGGGHDYHDALRKSILFYEGQRSGKLPPDQRIKWRRDSALHDGASAGVDLTGGYYDAGDNVKFVFPMAFTTTLLSWSIIDFKRNIGNELGNAVKAVKWGTDFLLKATARDGVIYVQVGDAFSDHSCWERPEDMDTLRTVYKIDANNPGSDVAGEIAAALAAASIVFRSLDSSYSNLLLDRAVKVFDFANRHRGAYSSSLHSAVCPFYCDFNGYQDELLWGAAWLHKATRRRQYREYIVKNEVILRAGDTINEFGWDNKHAGINVLISKEVLMGKAPDLKSFQVNADAFICSILPGISHPQVQYSPGGLIVKPGVCNMQHVTSLSFLLLTYSNYLSHANHVVPCGSMTATPALLKHIAKRQVDYILGDNPQRMSYMVGYGPHYPQRIHHRGSSVPSVATHSARIGCKEGSRYFFSPNPNPNRLIGAVVGGPNLTDSFPDARPYFQESEPTTYVNAPLVGLLAYFAAHSN

SEQ ID NO: 631 - protein, 746 aa, Solanum lycopersicum
MAESLVEPCTTSYPLKVSIFILFFLIFPFLNPFSSAFPLSHDTNATGVFNLETEEDMGLLLFFKLQFQETPLSSWDVSVPLSNWTGVTRSNQTGRVTGLNLTRFNLSGQVHPCLCNLTFLETLVLSHNSFNNSIPSCLWKLWSLKTLDLSYNIFTLLVPSTFAATMSKLIELDLSHNMLSGEIPMWIGNVSMSLEKLNLGFNSFHGDIPKSLLNLMSLKYLDLSHNSLMGNVGDFNQELVTLNLESNLLSGTLPCLYSSRESLTLLNLANNSILGGIPTCLSSLGGLTQLNLSHNELRYGISPRLVFSERLCLLDLSYNELSGKIPSRIVEASDKSGLLLLDLSHNQFSGNIPVTITELKSLQALFLSYNLLVGEIPERIGNLTYLQVIDLSHNFLTGSIPLNIVGCFQLLALILNSNNLSGEIQPVLDALDSLKIFDIGNNKISGEIPLTLAGCKSLEVVDLSSNNLSGSLNDAITKWSNLKFLSLARNKFSGSLPSWLFTFQAIHTLDFSGNKFSGYIPDGNFNTSPNFYNGDIRKTISAVPSISARSLDIKLSLVADETSLSFKYNLTTTIGIDLSDNLLHGEIPEGLFGLHGLEYLNLSYNFLNGPVPGSLGKLQKLKALDLSHNSLSGHIPENITSLRNLTVLNLSYNCFSGVISTKRGYWKFPGAFAGNPDLCMESSGNVCQRTLPVKPGKKFEEEMEEGPLSVWIFCISALVSFYVGVVVLFCSSRTRSCILQTKNLAG

SEQ ID NO: 632 - protein, 679 aa, Solanum lycopersicum
MSGGGCSIVWFRRDLRVEDNPALAAGVRAGAVIAVFIYAPEEEGHYYPGRVSRWWLKQSLAHLDSSLKSLGTSLITKRSTDSISSLLEVVKSTGATQLFFNHLYDPISLVRDHRTKEILTAQGISVRSFNADLLYEPWEVNDDEGRPFTTFSAFWEKCLSMPYDPEAPLLPPKRIISGDASRCPSDNLVFEDESEKGSNALLARAWSPGWSNADKALTTFVNGPLLEYSQNRRKADSATTSFLSPHLHFGEVSVRKVFHFVRIKQVLWANEGNKAGEESVNLFLKSIGLREYSRYMSFNHPYSHERPLLGHLRYFPWVVDEGYFKAWRQGRTGYPLVDAGMRELWATGWLHDRIRVVVSSFFVKVLQLPWRWGMKYFWDTLLDADLESDALGWQYISGTLPDGRELDRIDNPQFVGYKCDPHGEYVRRWLPELARLPTEWIHHPWNAPESVLEAAGIELGSNYPLPIVEIDSAKVRLEQALSQMWQNDAAARAAIENGMEEGHGDSADSPIAFPQAMHMEMDHEPVRNNPVIVTVRRYEDQMVPSMTSSLFRAEDEENSVDIRNSVVESRAEVPTDINVAEVHRRDTRDQAVMQTARTNATPHFNFAVGRRNSEDSTAESSSSTRERDGGVVPTWSPSSSNYSDQYVGDDNGIGTSSSYLQRHPQSHQLMNWQRLSQTG

SEQ ID NO: 633 - protein, 248 aa, Solanum lycopersicum
MSTHCVSIIKNFNLSSKMKEEDYDHEQVIKDQPIKIFDWSSILSSSKNEESSSTSLYVHPLDKSSRNSLSEKSLEICTESLGSETGSGSDCFLSSPTSEHEDSNDDKHDHHHYYHQQQYSVVSESFEDFHVYNHSKRLISSSKSFPPSLPSIHMQSHRQNGRLILEAASISPNNSLHAQRLDGHLLLTVINQNNYEHEIEKREDEVEEFEKVFDDIQEVEGKEIPHSDSGGGDEEEFEKVFDDIHVSF

SEQ ID NO: 634 - protein, 1207 aa, Solanum lycopersicum
MKAHKTVFNQHPLSLNKLFFVLLLIFFLPPASPAASVNGLYKDSQQLLSFKAALPPTPTLLQNWLSSTGPCSFTGVSCKNSRVSSIDLSNTFLSVDFSLVTSYLLPLSNLESLVLKNANLSGSLTSAAKSQCGVTLDSIDLAENTISGPISDISSFGVCSNLKSLNLSKNFLDPPGKEMLKAATFSLQVLDLSYNNISGFNLFPWVSSMGFVELEFFSLKGNKLAGSIPELDFKNLSYLDLSANNFSTVFPSFKDCSNLQHLDLSSNKFYGDIGSSLSSCGKLSFLNLTNNQFVGLVPKLPSESLQYLYLRGNDFQGVYPNQLADLCKTVVELDLSYNNFSGMVPESLGECSSLELVDISYNNFSGKLPVDTLSKLSNIKTMVLSFNKFVGGLPDSFSNLLKLETLDMSSNNLTGVIPSGICKDPMNNLKVLYLQNNLFKGPIPDSLSNCSQLVSLDLSFNYLTGSIPSSLGSLSKLKDLILWLNQLSGEIPQELMYLQALENLILDFNDLTGPIPASLSNCTKLNWISLSNNQLSGEIPASLGRLSNLAILKLGNNSISGNIPAELGNCQSLIWLDLNTNFLNGSIPPPLFKQSGNIAVALLTGKRYVYIKNDGSKECHGAGNLLEFGGIRQEQLDRISTRHPCNFTRVYRGITQPTFNHNGSMIFLDLSYNKLEGSIPKELGAMYYLSILNLGHNDLSGMIPQQLGGLKNVAILDLSYNRFNGTIPNSLTSLTLLGEIDLSNNNLSGMIPESAPFDTFPDYRFANNSLCGYPLPIPCSSGPKSDANQHQKSHRRQASLAGSVAMGLLFSLFCIFGLIIVAIETKKRRRKKEAALEAYMDGHSHSATANSAWKFTSAREALSINLAAFEKPLRKLTFADLLEATNGFHNDSLVGSGGFGDVYKAQLKDGSVVAIKKLIHVSGQGDREFTAEMETIGKIKHRNLVPLLGYCKVGEERLLVYEYMKYGSLEDVLHDRKKIGIKLNWPARRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGKQPTDSADFGDNNLVGWVKLHAKGKITDVFDRELLKEDASIEIELLQHLKVACACLDDRHWKRPTMIQVMAMFKEIQAGSGMDSTSTIGADDVNFSGVEGGIEMGINGSIKEGNELSKHL

SEQ ID NO: 635 - protein, 490 aa, Solanum lycopersicum
MMTTQNRRSSAVAKRQAMAANSSGLEHNQTGKLNAKKRPALSNISNNTTVSARNSVSHSSKLAPCTSKIVNIKKNTSACNSNAVSSGTAVLPASSSVRPSSKPVSIQRSDAVVPKITVIPVPATCSMDISPSHSDGSLVSMDESMSNSDTVRSPEVEYIDDHELAAVDSIEKKACSTLYISEHVKAAAADICKRDVLVDLESGDKIMNIDNNLVDPQLCATMACDIYKHLRASEAKKRPSTDFMAKVQKDINPSMRAILIDWLVEVAEEYRLVPDTLHLTINYIDRYLSGNLMDRQRLQLLGVACMMIASKYEEICAPQVEEFCYITDNTYFKEEVLQMESAVLNYLKFEMTAPTAKCFLRRFVRAAQGLNEVLSLQLEHLASYIAELSLLEYNMLCYAPSLIAASAIFLAKYILLPSVKPWNSTLRHYTLYQPSDLRDCVLALHSLCCNNNNSSLPAVREKYSQHKYKFVAKKYCPPTVPVEFFQNISS

SEQ ID NO: 636 - protein, 171 aa, Solanum lycopersicum
MANPKVFFDLTIGGAPAGRVVMELFADTTPKTAENFRALCTGEKGVGKMGKPLHYKGSTFHRVIPGFMCQGGDFTAGNGTGGESIYGAKFNDENFVKKHTGPGILSMANAGPGTNGSQFFICTAKTEWLNGKHVVFGQVVEGMDVIKKAEAVGSSSGRCSKPVVIADCGQL

SEQ ID NO: 637 - protein, 464 aa, Solanum lycopersicum
MAFFLIFLSSFFGLCIFCTALLRWNQVKYNQKNLPPGTMGWPLFGETTEFLKLGPSFMKNQRARYGSFFKSHILGCPTIVSMDSELNRYILVNEAKGLVPGYPQSMIDILGKCNIAAVNGSAHKYMRGALLSLISPTMIRDQLLPKIDEFMRSHLTNWDNKVIDIQEKTNKMAFLSSLKQIAGIESTSLAQEFMSEFFNLVLGTLSLPINLPNTNYHRGFQARKIIVNLLRTLIEERRASKEIQHDMLGYLMNEEATRFKLTDDEMIDLIITILYSGYETVSTTSMMAVKYLHDHPKVLEELRKEHMAIREKKKPEDPIDYNDYRSMRFTRAVILETSRLATIVNGVLRKTTQDMEINGYIIPKGWRIYVYTRELNYDPRLYPDPYSFNPWRWMDKSLEHQNSFLVFGGGTRQCPGKELGVAEISTFLHYFVTKYRWEEIGGDKLMKFPRVEAPNGLRIRVSAH

SEQ ID NO: 638 - protein, 467 aa, Solanum lycopersicum
MAIFLIIFVVFFGFCILSTPLFRWIDIVYNKKNLPPGTMGWPIFGETREFLNQGPNFMKNQRARYGNFFKSHILGCPTVVSMDAGLNVYILNNEAKGLIPGYPQSMLDILGKCNIAAVHGATHKYIRGALLSLINPTMIKDHILPKIDKFMRSHLSGWDNCNVIDIQQMTKEMAFFSSLDQIGGFATSSSIAQEFRAGFLNIALGTISLPINFPTTNYYRGLQGRKTIVKLLRKIIEDRRGSKKIQQDMLGLMMNEEAKNRYTLSDEELIDQIITIMYSGFETVSTTSMMAVKYLHDHPKALEEIRKEHFAIREKKSLEDPIDYNDFKAMRFTRAVIYETLRLATIVNGVLRKTTQDMELNGYMIPKGWRIYVYTRELNYDPLIYPDPYTFNPWRWLENNLDHQSSFLMFGGGTRLCPGKELGVAEISTFLHYFVTRYRWEEVGGNKLMKFPRVEALNGLWIKVSAY

SEQ ID NO: 639 - protein, 1090 aa, Solanum lycopersicum
MSVWNYVVTAHKPTNVTHSCVGNFTGPQELNLIIAKCTRIEIHLLTPQGLQPMLDVPIYGRIATLELFRPHGETQDLLFIATERYKFCVLQWDTEASEVITRAMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVSLKDKDFIEGPWAQNNLDNGASLLIPVPPPLCGVLIIGEETIVYCSASAFKAIPIRPSITRAYGRVDADGSRYLLGDHNGLLHLLVITHEKEKVTGLKIELLGETSIASTISYLDNAFVFIGSSYGDSQLVKLNLQPDTKGSYVEVLERYVNLGPIVDFCVVDLERQGQGQVVTCSGAYKDGSLRIVRNGIGINEQASVELQGIKGMWSLRSATDDPYDTFLVVSFISETRVLAMNLEDELEETEIEGFNSQVQTLFCHDAVYNQLVQVTSNSVRLVSSTSRDLKNEWFAPVGYSVNVATANATQVLLATGGGHLVYLEIGDGVLNEVKYAKLDYDISCLDINPIGENPNYSNIAAVGMWTDISVRIYSLPDLNLITKEQLGGEIIPRSVLMCSFEGISYLLCALGDGHLLNFVLSMSTGELTDRKKVSLGTQPITLRTFSSKDTTHVFAASDRPTVIYSSNKKLLYSNVNLKEVSHMCPFNVAAFPDSLAIAKEGELTIGTIDEIQKLHIRSIPLGEHARRISHQEQTRTFALCSVKYTQSNADDPEMHFVRLLDDQTFEFISTYPLDQFEYGCSILSCSFSDDSNVYYCIGTAYVMPEENEPTKGRILVFIVEDGKLQLIAEKETKGAVYSLNAFNGKLLAAINQKIQLYKWASREDGGSRELQTECGHHGHILALYVQTRGDFIVVGDLMKSISLLIFKHEEGAIEERARDYNANWMSAVEILDDDIYLGAENNFNLFTVRKNSEGATDEERSRLEVVGEYHLGEFVNRFRHGSLVMRLPDSDVGQIPTVIFGTVNGVIGVIASLPHDQYLFLEKLQTNLRKVIKGVGGLSHEQWRSFYNEKKTVDAKNFLDGDLIESFLDLSRNRMEEISKAMSVPVEELMKRVEELTRLH

SEQ ID NO: 640 - protein, 478 aa, Solanum lycopersicum
MSSYSELSNLPIREIPGDYGFPIISAIKDRYDYFYNQGEDAWFHNKAEKYKSTVVKINMAPGPFTSNDYKLVAFLDANSFVCMFDNSLIDKTDTLGGTFKPGKEYYGGYRPVAFIDTKDPNHAALKGYILSSFAKRHNLFIPLFRNTLSDHLFNNLEKQVTEQGKADFNALLPTMTFDFIFRLLCDQKNPSDTVLGAQGPEHLRKWLFPQLIPSLSAKKLPNIIEDMLFHNFLIPFGFIKSDYNKLVDAFSKSAVSMLDEAEKLGIKREEAVQNILFLVGINMFAGLNAFFPHLFRFVGEAGASLHTQLAKEIRSVIKEEGGAITLSAINKMSLVKSVVYETLRLRPPVPLQYGKAKKEFMVQSHDASYKINKGQFVVGYQPMASRDPKIFANPDEFVPDRFMNDGEKMLKHVLWSNGRETESPAPDNKQCPGKDLVHLLGRLILVEFFIRYDTFTLEITPLFRAPNVAFNTLTKASK

SEQ ID NO: 641 - protein, 523 aa, Solanum lycopersicum
MFKTNNVTARLFERQICTPAPGTSIHRARRFYENVVPSYTIYDVECPDHSFRKFTDDGLYFVSFSRNHQDLVVYRPTWLTFSCKEEDCDTHDLPLKARKFESFFTQLYSVTLASSGELICKDFFLYMESNQFGLFATSTAQIHDAPPTGGAIQGVPSVEKITFHLLRLVDGAILDERVFHNDYVNLAHSIGAFLYDDLLAIVSLRYQRIHILQIRDSGDLVDVRAIGEFCREDDELFLNSNSQVLVNHVGNGFHHSLPQSETSFLSGIKQRLLSYIFRGIWNEADQTMRVQCLKKKFYFHFQDYIDLIIWKVQFLDRHHLLIKFGSVDGGVSRNADIHPSFFAVYNMETTEIVAFYQNSADELYFLFELFSDHFHVSSKSSLHMNFMSSHSNNIHALEQLRCTKNKATNFSQFVKKMMASLPCSCQSQSPSPYFDQSLFRFDEKLISAIDRHRQSTDHPIKFISRRQPNILKFKMKPGPEAGSTDGRTKKICSFLFHPILPLALSVQQTLFLQASVVNIHFRR

SEQ ID NO: 642 - protein, 268 aa, Solanum lycopersicum
MSTAKITPSAASFATSIKHLAGIQLPRCQSTIFTSNSTKFRAPRRGFTVSMAASIETPLEVCVKQSITTPNKLGDCPFTQRVLLTLEEKHLPYDMKFVDLSNKPDWFLKISPEGKVPLIKLDEKWVPDSDVISQALEEKFPKPPLTTPPEKASVGSKIFPKFVAFLKSKDSGDGTEQALLDELTAFNDYLKENGPFINGNEVSAADLSLGPKLYHLEIALGNYKNWSIPDSLSYMKSYMKSIFSRESFINTRALKEDVIEGWRPKVMG

SEQ ID NO: 643 - protein, 455 aa, Solanum lycopersicum; identical to SEQ ID NO: 565

SEQ ID NO: 644 - protein, 754 aa, Solanum lycopersicum
MGSLLRMNRLLSSIVESCNCIIDPQLPADDLLMKYQYISDFFIALAYFSIPVELIYFVKKSAVFPYRWVLVQFGAFIVLCGATHLINLWTFNMHTRNVAIVMTTAKALTALVSCITALMLVHIIPDLLSVKTRELFLKKKAAQLDREMGIIRTQEETGRHVRMLTHEIRSTLDRHTILKTTLVELGRTLALEECALWMPTRTGLELQLSYTLRHQNPVGLTVPIQLPVINQVFGTNHVVKISPNSPVARLRPAGKYMPGEVVAVRVPLLHLSNFQINDWPELSTKRYALMVLMLPSDSARQWHVHELELVEVVADQVAVALSHAAILEESMRARDLLMEQNVALDLARREAEMAVRARNDFLAVMNHEMRTPMHAIIALSSLLQETDLTPEQRLMVETILKSSNLLATLINDVLDLSRLEDGSLQLDIGTFNLHALFREVHSLIKPIASVKKLFVTLSLSSDLPEYVIGDEKRLMQILLNVVGNAVKFSKEGNVSISAFVAKSDSLRDPRAPEFFAVPSENHFYLRVQIKDTGIGITPQDIPNLFSKFTQSQALATTNSGGTGLGLAICKRFVNLMEGHIWIESEGLGKGSTAIFIIKLGIPGRANESKLPFVTKLPANHTQMSFQGLKVLVMDENGVSRMVTKGLLTHLGCDVTTVGSRDECLRVVTHEHKVVIMDVSMQGIDCYEVAVVIHERFGKRHGRPLIVALTGNTDRVTKENCMRVGMDGVILKPVSVYKMRSVLSELLEHGVVLES

SEQ ID NO: 645 - protein, 736 aa, Solanum lycopersicum
MDCNCFDPLLPADELLMKYQYISDFFIAVAYFSIPIELVYFVQKSAVFPYRWVLVQFGAFIVLCGATHLINLWTSTPHTRTVAMVMTTAKFSTAAVSCATAVMLVHIIPDLLSVKTRELFLKNKAAELDREMGLIRTQEETGRYVRMLTHEIRSTLDRHTILKTTLVELGRALQLEECALWMPTRTGVELQLSYTLHHQNPVGFTVPIQLPVINQVFSANCAVKISPNSAVARLRPTRKYIPGEVVAVRVPLLHLSNFQTNDWPELSPKSYALMVLMLPSNSARQWHVHELELVDVVADQVAVALSHAAILEESMRARDLLIEQNVALDLARREAETAVRARNDFLGVMNHEMRTPMHAVVALSSLLQESELIPEQRLMVETILKSSNLLATLINDVLDLSRLEDGSLQLDVGTFNLHALFREVLNLIKPVAAVKKLFVTLSLSSDFPEVAIGDEKRLMQILLNVVGNAVKFSEEGSVSVSAVNAKSESLIDPRAPEFFPVQSENHFYLRVQVKDTGSGINPQDFPKLFCKFAQNQEPATKNSAGTGLGLAICKRFVNLMEGHIWIESEGVGKGSTAIFIVKLGIPGRLNESKLPFTAGLPANHMQMTFQGLKVLVMDDNGFSRMVTKSLLVHLGCDVTTIGSGDECLRILTREHKVLIMDASITGMNCYDVAVSVHEKFGKRLERPLIVALTGNTDQVTKENCLRVGMDGVILKPVSIDKMRSVLSGLLEHGTVL

SEQ ID NO: 646 - protein, 412 aa, Solanum lycopersicum
MDPDAFSASLFKWDPRGAMPPPSRLLEPVAPPQPPPSLPPPPPPQPLPTSSYSIRSTRELGGLEELFQAYGIRYYTAAKIAELGFTVNTLLDMKDEELDDMMNSLSQIFRWDLLVGERYGIKAAIRAEWRRLEEEEARRRGHILSDGGTNVLDALSQEGLSEEPVQQQHEREAAGSGGGGTWEVAAGGGGRMKQRRRKKAGRERRGEEDEETEELGEEDEENMNQGGGGGGISERQREHPFIVTEPGEVARGKKNGLDYLFHLYEQCRDFLIQVQTIAKERGEKCPTKVTNQVFRYAKKAGASYINKPKMRHYVHCYALHCLDEDASNALRRAFKERGENVGAWRQACYKPLVAIAARQGWDIDAIFNAHPRLAIWYVPTKLRQLCHSERSNAAAAASSSVSGGVADHLPHF

SEQ ID NO: 647 - protein, 328 aa, Solanum lycopersicum
MAVNGASSSGLIVSFGEMLIDFVPTVSGVSLAEAPGFLKAPGGAPANVAIAVTRLGGKSAFVGKLGDDEFGHMLAGILKTNGVQAEGINFDKGARTALAFVTLRADGEREFMFYRNPSADMLLTPAELNLDLIRSAKVFHYGSISLIVEPCRAAHMKAMEVAKEAGALLSYDPNLRLPLWPSAEEAKKQIKSIWDSADVIKVSDVELEFLTGSNKIDDESAMSLWHPNLKLLLVTLGEKGCNYYTKKFHGTVGGFHVKTVDTTGAGDSFVGALLTKIVDDQTILEDEARLKEVLRFSCACGAITTTKKGAIPALPTASEALTLLKGGA

SEQ ID NO: 648 - protein, 229 aa, Solanum lycopersicum
MVRGKVEMKRIENSTSRQVTFSKRRNGLTKKAYELSVLCDAEVAFIIFSHKGRLYEFASSNMQKIIERYRGRARETTTVDKSTELEHYMENLKHETANMAKKIEILEISKRKLMGQGLGSCSMDELEDIDSQLERTLKIIRARKTQLFKEEIESLKAKERLLLQQNASLREKCGLRPMLSESASAPEPIPAPPSTPPAQSKERGNCSQSTKSWEVETELFIGLPQTRCL

SEQ ID NO: 649 - protein, 410 aa, Solanum lycopersicum
MGCCKEEEPKWLWVNGPIIVGAGPSGLAVSACLKENGVPSLILERSDCIASLWQHKTYDRLKLHLPKQFCQLPLFDFPENFPKYPTKHQFISYLESYAKHFSITPKFKQSVKVAEFDGVCGFWKVQTQDFQYLSKWLIVATGENAEAVIPEIPGIDKFKGRVMHTSVYKSGTEFINQRVLVIGCGNSGMEVSLDLCRHNAIPHMVVRNSVHILPREMLGISTFSIAMALLKWMPLRIVDKLLLLVANLTLGSTDKLGLRRPKTGPLELKNATGKTPVLDVGALSQIKTGKIQIMPGVKEITKIGAKFLDGKEGEFDSIILATGYKSNVPSWFKGSDFFTEQGMPKTPFPNGWKGENGLYTVGFTRRGILGTANDAKNIARDISEQWREFKGFCKNFCTTKNLSDNQGICF

SEQ ID NO: 650 - protein, 349 aa, Solanum lycopersicum
MVSEKIQENIKLPIIDLSLEKSQILKLIVKASEEFGFFKVINHGVDTNVIKKMEDESYNFFSKSFSQKQCAGPANPYGYGCKNIGFNGDNGEVEYLLLHANPNMSISQISKNISSDPLMFSCAVNGYVKSVRELACKILELMAQGLRVQQTSVYSNLLMDLHSDSLLRINHYPPFNWTPHLLHHDCDTSPNSCNSTVSKIGFGEHTDPQILTILRSNDAPGLQISTQQGLWVPVSPHPNTAFSIFVGDTLQALTNGRFKSVRHRAMVNSCKPRMSMVYFGAPSPHARICCPLELVTTTPHKPYHLYRPFTWGEYKKATYSMRLGDTRLDQFFRLQSENDETITINNQTS

SEQ ID NO: 651 - protein, 322 aa, Solanum lycopersicum
MVILSKQTSFFNGVPLIDLSKPDSKNLIVNACEEFGFFKIINHDVPMEFISKLESEAIKFFSSPLSEKLKAGPADPFGYGNKQIGTNGDCGRVEHILVSTNSEFNYQKFASILGVNPENIRAAVNDYVSAVKKMSCDILEMLAEGLKIYPTNVFSKLLMDENSDSVFRLNHYPPCSEIERLNDNNNDLIGFGEHTDPQIISILRSNNTSGLQILLKDGHWISVPPDENSFFVNVGDSLQVMTNGRFKSVKHRVLANSVKSRLSMIYFGGPPLSEKIAPLASLMEGEDSSLYKEFTWFEYKKSAYKTRLADNRLILFEKIAAS

SEQ ID NO: 652 - protein, 331 aa, Solanum lycopersicum
MVVLTKPAITHFPIVKNSFKSPSYINDIPVIDLSKANSKNLIVNACEEFGFFKVINHDVPMEFISKLESEAVKFFSSPLSEKLKAGPADPFGYGNKKIGQNGDIGWVEYILLSTNSEFNYQKFASVLGVNPENIRAAVNDYVSSVKKMSCEILEKLAEGLKIQPTNVLSKLLMDEKSDSVFRLNHYPPCPDIQEFNAKNLIGFGEHTDPQIMSILRSNNTSGLQILLKNGNWFSVPSDQNSFFVNVGDSLQVMTNGRFKSVKHRVLTNSVKSRLSMIYFGGPPLSEKIAPLPSLMEGKDSLYKEFTWFEYKKSAYKTRLADNRLVLFEKSL

SEQ ID NO: 653 - protein, 335 aa, Solanum lycopersicum
MVVLTEPDNDHLPIINSNSCKSPSFFNDIPVIDLSKPDSKNLIVEACEEFGFFKVVNHDVPIEFISKLESEAIKFFSSPLSEKLKAGPADPFGYGNKQIGQSGDIGWVEYILLSTNSEFNYQKFASVLGVNPENIRAAVNDYVTAVKRMSCEILEKLAEGLKIHPTNVFSKLLKDEKSDSVFRLNHYPPCPDIQEFNAKNLIGFGEHTDPQIISVLRSNNTSGLQILLKNGNWFSVPPDQSSFFVNVGDSLQVMTNGRFKSVKHRVLTNSVKSRLSMIYFGGPPLSEKIAPLPSLMEGEESSLYKEFTWFEYKKSAFKSRLAQNRLTLFEKFGTS

SEQ ID NO: 654 - protein, 363 aa, Solanum lycopersicum
MRSMNLVDSWGQACLVINQSLPYNSFNGLMKINSKNRKILQQSLSYRTFSSVTVSAIATNEKVVMEKEEFNFKVYVAEKAICVNKALDEAIMVKDPPKIHEAMRYSLLAGGKRVRPMLCLAACELVGGNQGNAMAAACAVEMIHTMSLIHDDLPCMDDDDLRRGKPTNHKVYGEDVAVLAGDALLAFAFEYLATATTGVSPSRILVAVAELAKSVGTEGLVAGQVADLACTGNPNVGLEMLEFIHIHKTAALLEASVVIGAILGGGADEEVDKLRRFAQCIGLLFQVVDDILDVTKSSSELGKTAGKDLAVDKTTYPKLLGLEKAKEFAAELNGEAKQQLAAFDSHKAAPLIALADYIANRQN

SEQ ID NO: 655 - protein, 464 aa, Solanum lycopersicum
MLVVSPFSNTTARDERGNEMESFAIGGGGGGGDDFPDFMGENLLDSIDFDDLFVGINDGDVLPDLEMDTEILAEFSVSSGDESDVNNYSSSNNNNTFITTAIKNVERKEEIEKTGSVSASDVGSGLTTSLNQGEEIVSTQKSEESTQQRNQNIVTPKESDKGKKSSKNHNLPGKRKVKVDWTPELHRRFVQAVEQLGVDKAVPSRILEIMGIDCLTRHNIASHLQKYRSHRKHLLAREVEAASWSHRRQLYGGAPMVGGGGGKREMNPWPAPTIGFPPPPPLPPPVAPPMPHHFRPLQVWGHPSVDQSYMHMWPKHLAPSPSPQHPSPAWAPPPHHLHPPPPLDPSFWHPHHQRVQNSLTPGTPYFPAPTRYPVPGIPPVSSHGMYKVDQSNIGVRSTATLPAQPLPEPPCDFHPSKESIDAAIGDVLSKPWLPLPLGLKPPAVDSVLGELQRQGVPKIPPTCA

SEQ ID NO: 656 - protein, 310 aa, Solanum lycopersicum
MLALSSSLSYKNERENYDLFQDFSHGNLIDTINFDDFFDEINGGDLLPDFEIFCEEPAIHGNMKSKSKEAKKSSSKIKNPQGKKKVKLDWTPELHRKFVKAIEKLGVDKAVPSRILELMATHGLTRHNIASHLQKYRAHRKHLLAREAEAASLNHRKQMYSGATTIGGGGKRILMNPWPAPPTMGFPPMAHHVRPLHVWGHPHVNNSFWHPHYQRVSNSLVPGTPCFSAPITSARFAAPLMVPGIPPSPAIIKVDTVASDLHPSNESIDAAIEDVLSKPQLPLPIGLKPPSIDSVLNELQRQGITKIPPT

SEQ ID NO: 657 - protein, 278 aa, Solanum lycopersicum
MASISPLSQSQPLLEKPQFTVLNKSQNQFFSIPFSRFTQSCNLSLKKSRMVVVSATTAAEKSNKRYPGEAKGFVEEMRFVAMKLHTKDQAKEGEKEPVDQPLAKWEPSVEGYLKFLVDSKLVYDTLERIVEKAPFPEYAEFRNTGLERSEVLAKDLEWFRQQGHAIPEPSTPGVTYASYLEELSEKDPQAFICHFYNTYFAHSAGGRMIGKKVAEKVLDKKELEFYKWDGDLSQLLQNVRDKLNKVAENWTREEKNHCLEETEKSFKFSGAILRLIFS

SEQ ID NO: 658 - protein, 208 aa, Solanum lycopersicum
MSSNKLDFEETELRLGLPGGARKNVYGDNDTCNVNGKRGFVDLKLNLSSDINNIKNSTHKTPAAKAQVVGWPPVRSFRKNILTSQKLDRENDNILVKVSMDGAPYLRKVDLNMYKSYQELFDALTKMFNSFTIVQGMKDFMHEGKLMDLLNSSDYVPTYEDKDGDWMLVGDVPWGMFVDSCKRLRIMKGTEAIGLAPRAMEKCKNRNG

SEQ ID NO: 659 - protein, 250 aa, Solanum lycopersicum
MGRGRVELKRIENKINRQVTFAKRRNGLLKKAYELSILCDAEVALIIFSSRGKLYEFSSASSMMTTLEKYQQCSYASLDPMLPVSDTQMNYNEYVRLKARVELLQRSQRHILGEDLGTLNSKELEQLEHQLDASLKKVRSKKTQSMLDQLADLQEKEQMLEEANKQLKNKLEESAARIPLGLSWGNNGGQTMEYNRLPPQTTAQPFFQPLRLNSSSPQFGYNPNMGANDHEVNAATTAHNINGFIPGWML

SEQ ID NO: 660 - protein, 228 aa, Solanum lycopersicum
MARGKIQIKKIENQTNRQVTYSKRRNGLFKKANELTVLCDAKVSIVMISSTGKLHEFISPSITTKQLFDLYQKTIGVDIWTTHYEKMQEQLRKLKDVNRNLRKEIRQRMGESLNDLNYEQLEELMENVDNSLKLIRERKFKVIGNQIETYRKKVRNVEEINRNLLLEFDARQEDPYGGLVEHDGDYNSVLGFPTGGPRILDLRLQPNNNYHNHLHSGGGSDITTFALG

SEQ ID NO: 661 - protein, 242 aa, Solanum lycopersicum
MYMGSSSGSLSMKVHQFTRGFLEHEAASPSLTLGCKRLRPLAPKLNTTNNDTTTTIVTPPFDLKSFIRPESSNSPPKLAYNEDKKDSSQVESHPGGTRWNPTQEQIGILEMLYRGGMRTPNAQQIEQITAQLGKYGKIEGKNVFYWFQNHKARERQKQKRNSLGLSQSPRTPSAIVTSPLSFDTRGEVVRDEDSPYKRKCRGWTFEYMEEEQQQQDEEEIINCRENGDRTLQLFPLHPEGMR

SEQ ID NO: 662 - protein, 842 aa, Solanum lycopersicum
MKLSTSGMGQQAHEGGEKKCLNSELWHACAGPLVCLPTVGSRVVYFPQGHSEQVAATTNKEVDAHIPNYPNLSPQLICQLHNVTMHADVETDEVYAQMTLQPLTPEEQKDTYLPVEFGIPSKQPTNYFCKTLTASDTSTHGGFSVPRRAAEKVFPPLDFSQTPPAQELIARDLHDVEWKFRHIFRGQPKRHLLTTGWSVFVSAKRLVAGDSVLFIWNEKNQLLLGIRRAVRPQTVMPSSVLSSDSMHIGLLAAAAHAAATNSCFNVFFNPRASPSEFVIPLSKYIKAVYHTRVSVGMRFRMLFETEESSVRRYMGTITGIGDLDPVRWANSHWRSVKVGWDESTAGERQPRVSLWEIEPLTTFPMYPSLFPLRLKRPFYQGTSSYQDSNNEAINRMSWLRGNAGELGHHSMNLQSFGMLPWMQQRVDSTILPNDINQHYQAMLATGLQSFGSGDLLKQQLMQFQQPVQYLQHASTENSILHQQQQQQQQIMQQAVHQHMLPAQTQMLSENLQRQSQHQSNNQSEEQAHQHTYQEAFQLPHDQLQQRQPSNVTSPFLKADFADLTSKFSASVAPSGVQNMLGSLCSEGSNNSLNINRTGQSVIIEQSPQQSWMSKFTESQLNTCSNSSSLPTYGKDTSNPRGNCSLDSQNQALFGANIDSSGHLLPTTVSNVTTTCADMSLMPLGASGYQNSLYGYVQDSSELLHNAGQIDPPNATHTFVKVYKSGCVGRSLDITQFHSYHELRRELGQMFGIEGFLEDPQRSGWQLVFVDRENDILLLGDDPWEAFVNNVWYIKILSPEDVQKLGKEEAESLNRGAVERMSSTNADDRDLISGMPSLGSLEY

SEQ ID NO: 663 - protein, 270 aa, Solanum lycopersicum
MCIVVFIWEADSRYSLVLLLNRDEYHNRPTKEVHWWEDGEIVGGKDEVGGGTWLASSTNGKLAFLTNVLEIHTLPHAKTRGDLPVRFLQSNKSPMEFAKGLVNEGNEYNGFNLILADIESKKMVYVTNRPKGEPITIQEVQPGIHVLSNAKLDSPWPKAQRLKLNFKKMMDVYEVNDEKICVKDMIEKLMRDTTKADKSKLPCICSTDWELELSSIFVEVDTPLGCYGTRSTTALTIEVGGKVSFYELYLENNMWKEQIVNYRIEKLQMQ

SEQ ID NO: 664 - protein, 428 aa, Solanum lycopersicum
MLGSFGSSSSQSHPHHDEESSDHHQQRRFTATATTITTTTITTSPAIQIRQLLISCAELISQSDFSAAKRLLTILSTNSSPFGDSTERLVHQFTRALSLRLNRYISSTTNHFMTPVETTPTDSSSSSSLALIQSSYLSLNQVTPFIRFTQLTANQAILEAINGNHQAIHIVDFDINHGVQWPPLMQALADRYPAPTLRITGTGNDLDTLRRTGDRLAKFAHSLGLRFQFHPLYIANNNHDHDEDPSIISSIVLLPDETLAINCVFYLHRLLKDREKLRIFLHRVKSMNPKIVTIAEKEANHNHPLFLQRFIEALDYYTAVFDSLEATLPPGSRERMTVEQVWFGREIVDIVAMEGDKRKERHERFRSWEVMLRSCGFSNVALSPFALSQAKLLLRLHYPSEGYQLGVSSNSFFLGWQNQPLFSISSWR

SEQ ID NO: 665 - protein, 244 aa, Solanum lycopersicum
MGRGKVELRKIENKINRQVTFSKRRGGLVKKAHEISVLCDAEVALIVFSQKGKIFEYSSDSCMEQILERYERYSYAERRLLANNSESPVQENWSLEYTKLKARIDLLQRNHKHYMGEDLDSMSLKDLQNLEQQLDSALKLIRSRKNQLMHESISELQKKERAILEENNMLTKKIKEKDKIVEQQGEWHQQTNQVSTSTSFLLQPHQCLNMGGNYQDEVAEARRNNELDLNLDSLYPLYNMNKHL

SEQ ID NO: 666 - protein, 424 aa, Solanum lycopersicum
MGKDEDEMRGEIEERLINEEYKIWKKNTPFLYDLVITHALEWPSLTVEWLPDREEPSGKDYSVQKMILGTHTSENEPNYLMLAQVQLPLEDAENDARHYDDDRSEFGGFGCANGKVQIIQQINHDGEVNRARYMPQNPFIIATKTVSAEVYVFDYSKHPSKPPLDGACNPDLRLRGHSTEGYGLSWSQFKQGHLLSGSDDSHICLWDINATPKNKALEAMQIFKVHEGVVEDVAWHLRHEYLFGSVGDDQYLHVWDLRTPSVTKPIQSVVAHQSEVNCLAFNPFNEWVVATGSTDKTVKLFDLRKISTALHTLDCHKEEVFQVGWNPKNETILASCCLGRRLMVWDLSRIDEEQTPEDAEDGPPELLFIHGGHTSKISDFSWNPCEDWVVASVAEDNILQIWQMAENIYHDEDDLPGDDAPKGP

SEQ ID NO: 667 - protein, 609 aa, Solanum lycopersicum
MVSILSNIGMMVVTFKRPSLFTSLRRRSANNIIITKHSHPISTTRRSGNYKPTMWDFQFIQSLHNPYEGDKYMKRLNKLKKEVKKMMMTVEGSHDEELEKLELIDNLERLGVSYHFKDEIMQIMRSINININIAPPDSLYTTALKFRLLRQHGFHISQDILNDFKDENGNLKQSICKDTKDILNSSKDEHDNLKQSTCNNTKGLLKLYEASFLSIENESFLRNTTKSTLAHLMRYVDQNRCGEEDNMIVELVVHALELPRHWMVPRLETRWYISIYERMSNANPLLLELAKLDFNIVQATHQQDLRILSRWWKNTGLAEKLPFSRDILVENMFWAVGALFEPQHSYFRRLITKVIVFISIIDDIYDVYGTLDELELFTLAIQRWDTKAMEQLPDYMKVCYLALINIINEVAYEVLKNHDINVLPYLTKSWADLCKSYLQEAKWYHNGYKPNLEEYMDNARISIGVPMVLVHSLFLVTNQITKEALDSLTNYPDIIRWSATIFRLNDDLGTSSDELKRGDVSKSIQCYMNEKGASEEEAIEHIEFLIQETWEAMNTAQSKNSPLSETFIEVAKNITKASHFMYLHSDVKSSISKILFEPIIISNVAFALK

SEQ ID NO: 668 - protein, 689 aa, Solanum lycopersicum
MTEYSLPTMNLWNNSTSDDNVSMMEAFMSSDLSFWATNNSTSAAVVGVNSNLPHASSNTPSVFAPSSSTSASTLSAAATVDASKSMPFFNQETLQQRLQALIDGARETWTYAIFWQSSVVDFSSPSVLGWGDGYYKGEEDKAKRKLSVSSPAYIAEQEHRKKVLRELNSLISGAPPGTDDAVDEEVTDTEWFFLISMTQSFVNGSGLPGQALYSSSPIWVAGTEKLAASHCERVRQAQGFGLQTIVCIPSANGVVELGSTELIVQSSDLMNKVRVLFNFSNDLGSGSWAVQPESDPSALWLTDPSSSGMEVRESLNTVQTNSVPSSNSNKQIAYGNENNHPSGNGQSCYNQQQQKNPPQQQTQGFFTRELNFSEFGFDGSSNRNGNSSVSCKPESGEILNFGDSTKKSASSANVNLFTGQSQFGAGEENNNKNKKRSATSRGSNEEGMLSFVSGTVLPSSGMKSGGGGGEDSEHSDLEASVVKEADSSRVVEPEKRPRKRGRKPANGREEPLNHVEAERQRREKLNQRFYALRAVVPNVSKMDKASLLGDAISYINELKSKLQNTESDKEDLKSQIEDLKKESRRPGPPPPPNQDLKMSSHTGGKIVDVDIDVKIIGWDAMIRIQCNKKNHPAARLMAALMELDLDVHHASVSVVNDLMIQQATVKMGSRHYTEEQLRVALTSKIAETH

SEQ ID NO: 669 - protein, 301 aa, Solanum lycopersicum; identical to SEQ ID NO: 598

SEQ ID NO: 670 - protein, 431 aa, Solanum lycopersicum
MAGQTVIVSGLNPAAILQSTIGGAPVAAAAENGHTRKVVPLSKDALQDFMVSIITQKLQDDKQPFYVLDLGEVVSLMEQWNSALPNIRPFYAVKCNPEPSFLSMLSAMGSNFDCASRAEIEYVLSHGISPDRIVFANPCKPESDIIFAEKIGVNLTTYDSEDEVYKIRKHHPKCELLLRIKPMTDGNARCPMGPKYGALPEEIEPLLRTAQAARLTVSGVSFHIGSGDADSNAYLGAIAAAKQVFETAAQLGMPKMTVLDIGGGFTSGHQFTTAAPAVKSALETHFHDFPELTIIAEPGRFFAETAFTLATTIIGKRVRGELKEYWINDGLYGSMNCVLYDHATVTATPLACMSNRNNLNCGGSKTFPSTVFGPTCDALDTVLRDYQLPELQVNDWLIFPNMGAYTKAAGSNFNGFNTSAIVTHLAYAYPN

SEQ ID NO: 671 - protein, 163 aa, Solanum lycopersicum
MYQTVGYNPGPMKQPYVPPHYVSAPGTTTARWSTGLCHCFDDPANCLVTSVCPCITFGQISEILNKGTTSCGSRGALYCLLGLTGLPSLYSCFYRSKMRGQYDLEEAPCVDCLVHVFCEPCALCQEYRELKNRGFDMGIGWQANMDRQSRGVTMPPYHAGMTR

SEQ ID NO: 672 - protein, 352 aa, Solanum lycopersicum
MGKSLKLRFSRVIASFNSCRSKNPSSLPQNPNFFPHKLTSTKHISPDFPLIDQNQNQNHRNYVPESTMISVGCCRSEFKWEKEEKFHVVSSSFVSEEEECEEEINLALRPPLTPPRFSRIVVEKKKKKQQRVKKTKTKSRIIRMSTSSADEYSGILSGTNTDWDNNEEETESLVSSSRSCYDFSSDDSSTDFNPHLETICETTTMRRRHKRNANTKRRSIKQSRPSFSSSKGRRSSVSTSSDSELPARLSVFKKLIPCSVDGKVKESFAIVKKSQDPYEDFKRSMMEMILEKEMFEKNELEQLLQCFLSLNGKHYHGVIVEAFSDIWETLFLGNNDRVRRMSIHDPTPTYCR

SEQ ID NO: 673 - protein, 457 aa, Solanum lycopersicum
MVIQRNSILLLIIIFASSISTCRSNVIDDNLFKQVYDNILEQEFAHDFQAYLSYLSKNIESNNNIDKVDKNGIKVINVLSFGAKGDGKTYDNIAFEQAWNEACSSRTPVQFVVPKNKNYLLKQITFSGPCRSSISVKIFGSLEASSKISDYKDRRLWIAFDSVQNLVVGGGGTINGNGQVWWPSSCKINKSLPCRDAPTALTFWNCKNLKVNNLKSKNAQQIHIKFESCTNVVASNLMINASAKSPNTDGVHVSNTQYIQISDTIIGTGDDCISIVSGSQNVQATNITCGPGHGISIGSLGSGNSEAYVSNVTVNEAKIIGAENGVRIKTWQGGSGQASNIKFLNVEMQDVKYPIIIDQNYCDRVEPCIQQFSAVQVKNVVYENIKGTSATKVAIKFDCSTNFPCEGIIMENINLVGESGKPSEATCKNVHFNNAEHVTPHCTSLEISEDEALLYNY

SEQ ID NO: 674 - protein, 444 aa, Solanum lycopersicum
MATIKSIKARQIFDSRGNPTVEVDVHISNGVFARAAVPSGASTGIYEALELRDGGSDYLGKGVSKAVNNVNSIIGPALVGKDPTDQTGLDNFMVHQLDGTQNEWGWCKEKLGANAILAVSLAVCKAGAAVRNVPLYKHIADLAGNKKLVLPVPAFNVINGGSHAGNKLAMQEFMILPVGAANFKEAMKMGCEVYHHLKAVIKKKYGQDATNVGDEGGFAPNIQENKEGLELLKTAIEKAGYTGKVVIGMDVAASEFYGKDKSYDLNFKEESNDGSQKISGDQLKDLYKSFVSEYPIVSIEDPFDQDDWETYAKLTAEIGEQVQIVGDDLLVTNPKRVAKAIAEKTCNALLLKVNQIGSVTESIEAVKMSKKAGWGVMTSHRSGETEDTFIADLAVGLSTGQIKTGAPCRSERLAKYNQLLRIEEELGSEAVYAGASFRKPVEPY

SEQ ID NO: 675 - protein, 1123 aa, Solanum lycopersicum
MSSSRPSQSSTTSSRSKHSARIVAQTSIDAKLHADFEESGDSFDYSSSVRVTSVAGDEEKPKSDKVTTAYLHQIQKGKFIQPFGCLLALDEKTLKVIAFSENAPEMLTMVSHAVPSVGEHPVLGIGTDIRTIFTGPSGAALQKALGFGEVSLLNPVLVHCKNSGKPFYAIVHRVTGSLILDFEPVKPYEVPMTAAGALQSYKLAAKAITRLQSLPSGSMERLCDTMVQEVFELTGYDRVMGYKFHEDDHGEVVSEITKPGLEPYLGLHYPATDIPQAARFLFMKNKVRMICDCRAKHVKVVQDEKLPFDLTLCGSTLRAPHYCHLQYMENMNSIASLVMAVVVNDGDEEGESSDSSQSQKRKRLWGLVVCHNTTPRFVPFPLRYACEFLAQVFAIHVNKELELENQFLEKNILRTQTLLCDMLMRDAPLGIVSQSPNIMDLVKCDGAALLYKNKIHRLGMNPSDFQLQDIVSWLCEYHTDSTGLSTDSLYDAGFPGALALGDAVCGMAAVRISDKDWLFWFRSHTAAEVRWGGAKHEPGEKDDGRKMHPRSSFKAFLEVVKTRSIPWKDYEMDAIHSLQLILRNAFKDAEVVNSNTNSIYKKLNDLKIDGMQELESVTAEMVRLIETALVPILAVDVDGQVNGWNTKIAELTGLPVDEAIGKHLLTLVEDSSVDTVNKMLELALQGKEEKNVEFEIKTHGPSRDSSPISLIVNACASKDVRDNVVGVCFMAHDITGQKSIMDKFTRIEGDYRAIIQNPHPLIPPIFGTDQFGWCSEWNTAMTKLTGWRRDDVMDKMLLGEVFGTQAACCRLKNQEAFVNFGVVLNNAITGQESEKIPFGFFARYGKYVECLLCVSKRLDKEGAVTGLFCFLQLASHELQQALYVQRLSEQTALKRLKVLAYIRRQIRNPLSGIIFSRKMLEGTSLGEEQKNILHTSAQCQRQLNKILDDTDLDSIIDGYLDLEMLEFKLHEVLVASISQVMMKSNGKNIMISNDMVEDLLNETLYGDSPRLQQVLANFLLVSVNATPSGGQLSISGRLTKDRIGESVQLALLEFRIRHTGGGVPEELLGQMFGSEADASEEGISLLVSRKLVKLMNGEVQYLREAGQSTFIISVELAVATNSS

SEQ ID NO: 676 - protein, 1121 aa, Solanum lycopersicum
MASGSGSRGKHDRNHQPKNQSQFSGTSNTNALSKAVAQYTTDARLHAAFEQSGESGKNFDYSQSVRNSTESVTEHQITAYLNKMQRGGHIQPFGCTIAVEEASFCVIAYSENACEMLDIMPQSVPSLEKNEILKIGTDVRTLFSSSSSGLLEGAFGAREITLLNPIWVHSKNSGKPFYAILHRIDVGIVIDLEPARTEDPALSIAGAVQSQKLAVRAISLLQSLPGGDIDLLCDTVVKSVRELTGYDRVMVYKFHDDEHGEVVAESRRSDLEPYIGLHYPATDIPQASRFLFKQNRVRMIVDCTAIPVRVIQDESLMQPLCLVGSTLRAPHGCHPQYMVNMGNVASLTLAVVINGNDDEVVGGRNAMRLWGLVVGHHSSARFIPFPLRYACEFLMQAFGLQLNMELQLASQLAEKRVLRTQTVLCDMLLRDSPTGIVTQNPSIVDLVKCDGAALYYQGRYYPLGITPTAAQIKGIVEWLLTCHVDSTGLSTDSLADAGYPEAASLGAAVCGMAVAYVTSKYFLFWFRSHTASEIKWGGAKHHPEDKDDWQKMHPRSSFKAFLEVVKNRSLPWENAEMDAIHSLQLILRDSFKDASNSKSIVRVQLREEGLQGMDELRSVAREMVRLVETATAPIFAVDVEGRINAWNAKVAELTELSVEEAIGKSLVHDLVHEESQTTAQNLLRKALRGEEDKNIEIKLRTFGAEQLKKTVFVEVNACSNKDYTNNIVGVSFIGQDITAQKVVLDKFVRIQGDYKAIMHSPNPLIPPIFVSDENTCCFEWNTAMEKLSGWNKEEIIGKMLVGEIFGTFCRLKGPDDMTNFMIMLHKAIGGQEIDKFPFSFSDRNGKFVQALLTANKRVNVDGQIIGAFCFLQIASPELQKTLMQRQQEKTSNIHMKELAYICRELKNPLNGIRFTNSLLEATELTENQKQFLETSAACERQMSKIIRDIDLDNIEDGSLELEKGEFFLASVIDAVVSQVMLLLRERGVQLIRDIPDEIKTLRVYGDQVRIQQVFADFLQIMASYAPPREGWVEVHLRPSIKQISDGVTIVHIEFRIVCPGEGLPPELIQDMFHNSLWVTQQGLGLSMCRRILQLMNGQVQYIRESERCFFLIILQLPMLIQ

SEQ ID NO: 677 - protein, 1137 aa, Solanum lycopersicum
MESQSSENRRGGGGRTSLNQNKQNNNKDSGLNTSSAASNMKNNASKAALAQYNADAKLMAEFEQSSVSGKSFDYSKSVLFPPHEANEEEITSYLSRIQRGGLVQPFGCMVAIEEPTFKIIGYSENCYDMLGFKPTKMKLGLIGVDARNLFTPSSGDSLAKVMASREISLLNPIWVHSRTTHKPFYAILHRIDVGIVIDLEPANSSDPALLLAGAVQSQKLAVRSISRLQSLPGGDIGVLCDTAVEDVQKLTGYDRVMVYKFHDDNHGEIVSEIRRSDLEPYLGLHYPATDIPQAARFLFKQNRVRMICDCNAQPVKVVQSEELKQPICLVNSTLRSPHECHSKYMANMGSISSLVMAVLINSGDSMKLWGLIVCHHTSPRYVPFPLRYACEFFTQAFGLQLNMELQLASQLAEKKTLQMQTLLCDMLLRDVPFGVVTQSPSIMDLVKCDGAALYCGGKCWLLGVTPTEAQVKDIAQWLLVAHKDSTGLSTDCLADAGYPGAALLGDAVCGMATARITSKDFLFWFRSHTAKEVKWGGAKHHPDDKDDGGKMHPRSSFNAFLEVVKSRSLPWEIPEINAIHSLQIIMRESIQENENSSLKTLTTSQQNDADGPSMDELSSVAMEMVRLIETATAPIFGVDPSGLINGWNEKIADLTGLHASEAVGMSLINDITHEDSRGTVEKVLHRALLGEEEKNVEIKLRRFGKDPPGSVIYLVINACTSRDHKNGVVGVSFVAQDVTPEKFIMDKFIQLRGDYEAIVQSLSPLIPPIFASDENACCSEWNAAMERLTGWTKYEVMGRTLPGEVFGGLCRLTGQDALTKFMILFYQAISGHDTKKLPFGFFNRRGEFLEVFLTANKRTDEHGNVCGCFCFLQPMTIDPEASDERQDSKDSLWKYKEYAYVLQQMKNPLNGIQFTHKLLEATGVSDNQKQLLETSEACEKQILSVIDNMDFGGIEDGKVQLNMEEFVLGNVVDAIVSQVMIFLKEKNLQLLHDIPDQIKTLPLYGDQIKLQRVLSDFLLSVVHHAPSPDGWVEIKVLPGLKLIQDGNELIHLQLRMTHPGQGLPAALIDDMSGERNRWTTQEGIALNVAQKLLNVMNGHVRYVRGEDKCYFLIDVELQTSKPTQHGPKLEVTQEIEI

SEQ ID NO: 678 - protein, 631 aa, Solanum lycopersicum
MINGKDIYDVLAAIIPLYVAMILAYGSVRWWKIFTPDQCSGINRFVAVFAVPLLGFHFISTNDPYAMNYHFIAADSLQKVVILFALFIWHLFSKRGNLEWVITLFSLSTLPNTLVMGIPLLKAMYGDFSGNLMVQIVVMQSVIWYTLMLFLFEYRGAKLLIGEQFPETAASITSFRVESDVVSLNGREPLQADAEIGDDGKLHVIVRRSSASSIISSYNKGILQSNNMTPRASNLTGVEIYSVQSSREPTPRASSFNQTDFYAMFASKTASPKHGYTNSYGGDVFSLQSSKGPTPRTSNFEEEMSKIGSNKKNRGGRSMSGELYNSSSTASTNGLVYPPPNPMFVGQRKKEVGSGSGVPTPVPVPVPVPVSMSNSNSNSNSKELHMFVWSSSASPTSEGNHKHAISKGGSSELGVLDASKAVLQQEIAAARENASSVSKGNVDKEIEIEDGSKNIEDGEKKSQMPPASVMTRLILIMVWRKLIRNPNTYASLIGLIWSLISYRWNIQMPSIVKGSISILSDAGLGMAMFSLGLFMALQPKIIACGKSVATFSMAVRFLTGPAVIAATSIAIGLRGVLLHVAIVQAALPQGIVPFVFAKEYNLHPDILSTAVIFGMLVALPITILYYVLLGV

SEQ ID NO: 679 - protein, 604 aa, Solanum lycopersicum
MISWHDLYVVLTAVVPLYVAMILAYGSVRWWKIFSPDQCSGINRFVAIFAVPLLSFHFISMNNPYEMNFRFIAADTLQKVIMLIVLCIWSNVTKNGSLEWSITIFSLSTLPNTLVMGIPLLIAMYGDYSGSLMVQVVVLQCIIWYTLLLFLFEFRGAKMLIMEQFPETAGEIVSFKVESDVVSLDGQDFLETDAELGRDGKLHVTLRKSNVSRRSFAMTPRPSNLTGAEIYSLNSSRNPTPRGSNFNHSDFYAMMGFPGRLSNFGPVDSTPRPSNFEENCAQGSPKFGFYPAQSNYPAPNPEIASIVSINTKNQQVQYQHQHQQQQNGKASHDAKELHMFVWSSSASPVSEAAGLHVFGGTDFSANEQSCRSDGAKEIRMLVPDHPQIGDNKEFSFGGSTGGGDEKSKDEKKEEKEGLTGVHTTTTGVQDSGTRKHMPPASVMTRLILIMVWRKLIRNPNTYSSLIGLIWSLISYRWHVHMPKIIEKSISILSDAGLGMAMFSLGLFMALQPKIIACGNTVATFAMAVRFLTGPAVMAAASIIVGLRGTLLHVAIVQAALPQGIVPFVFAKEYNVHPAILSTAVIFGMLIALPITLVYYIILGL

SEQ ID NO: 680 - protein, 653 aa, Solanum lycopersicum
MITWHDLYVVLTAVVPLYVAMILAYGSVRWWKIFSPDQCSGINRFVAIFAVPLLSFHFIAMNNPYEMNFRFIAADSLQKVIMLVVLSLWANLTKNGSLEWSITIFSLSTLPNTLVMGIPLLIAMYGEYSGSLMVQVVVLQCIIWYTLLLFLFEYRGAKMLIMEQFPETAASIVSFKVESDVVSLDGHDFLETDAEIGQDGKLHVTVRKSNASRRSFAMDHRPSNLTGAEIYSLSSSRNPTPRGSNFNHNDFYSMMGFPGGRLSNFGPADMYSVQSSRGPTPRPSNFEENCAPGGLVQSSPRFGYFPTQQPAPGSYPAPNPEIASAGPKSTKPQQPNVQTQKQEVQQQQQQHQQPNAKANNHDAKELHMFVWSSSNSPVSEAGGLHVFGGNDFSANEQSGRSDGAKEIRMLVSDHTQNGDSKAIPQIGEFGGEDFTFGGANGGGKDGDEEKGEKEGPTGLTKLGSSSTSELHPKLAGVQDAGMGKQMPPASVMTRLILIMVWRKLIRNPNTYSSLIGLIWSLISFRWHVHMPKIIEKSISILSDAGLGMAMFSLGLFMALQPKIIACGNTVATFAMAVRFLTGPAVMAAASIAVGLRGTLLHVAIVQAALPQGIVPFVFAKEYNVHPAILSTAVIFGMLIALPITLVYYIILGL

SEQ ID NO: 681 - protein, 586 aa, Solanum lycopersicum
MITVSDLYHVLTAVVPLYVAMILAYGSVKWWKIFSPDQCSGINRFVALFAVPLLSFHFIASNNPYAMNYRFIAADTLQKVIVLVVLAIWSRISSRGSLEWSITLFSLSTLPNTLVMGIPLLKGMYGDASGSLMVQIVVLQCIIWYTLMLFLFEYRGARMLIAEQFPDTGGSIVSFKIDSDVISLDGKEPLETQAEVGDDGKLHVVVRKSASSRSEIFSRMSHGHNTGGLSMTPRPSNLSNAEIYSLQSSTNMTPRDSNFNHNDIYSMVNGKNNANMSPRTSNFGNLGFDEESGFGKTNVGYPAPTNAGIFSPAIGPGTKKKANGTESGKDLHMFVWSSSASPVSEGGIHVFRGGDFGNELGIGHHSKDYDDFGREEFSLRDKNNSNGCHREEPVLKKLGSSSTAELFPRTATETKATAMPAASVMTRLILIMVWRKLIRNPNTYSSLLGLAWSLISFRWNIQMPLVFAKSISILSDAGLGMAMFSLGLFMALQPKMISCGKSIAAFSMAVRFISGPAVMAAASFAIGLRGVLLHIAIVQAALPQGIVPFVFAKEYNLHPDILSTGVIFGMLIALPITLVYYILLGL

SEQ ID NO: 682 - protein, 594 aa, Solanum lycopersicum
MISLSDLYHVLTAVVPLYVAMILAYGSVKWWKIFSPDQCSGINRFVALFAVPLLSFHFIASNNPYAMNYRFIAADTLQKIIVLFVLAIWSRVSSRGSLEWSITLFSLSTLPNTLVMGIPLLKGMYGDASGSLMVQIVVLQCIIWYTLMLFLFEYRGARMLIAEQFPDTGGSIISFKVDSDIISLDGKEPLETQAEVGDDGKLHVTVRKSTSSRSEIFSRRSHGPNSGLSLTPRPSNLTNAEIYSLQSSRNPTPRGSSFNHTDFYSMVNGKNANMSPRNSNFGNYGHDEESGVAGFGRGNGVYGQGNAGYPAPTNAGIFSPATGPVTKKKANGGTEGGKDLHMFVWSSSASPVSEGGIHVFRGGGDYGNELGVGAHPKDYDEFGREEFTFGNKQNLNGNDREGPVVRSSSTTELRPKIAQEETKATAMPPASVMTRLILIMVWRKLIRNPNTYSSLIGLTWSLVSFKWNVQMPAIIAKSISILSDAGLGMAMFSLGLFMALSPRIIACGKTIAIFSMGVRFLTGPAVMAAASIAVGLRGVLLHIAIVQAALPQGIVPFVFAKEYGVHPDILSTGVIFGMLVALPITLVYYILLGL

SEQ ID NO: 683 - protein, 133 aa, Solanum lycopersicum
MSWQTYVDDHLMCDIEGTGHHLSSAAILGFDGSVWAQSPNFPKFKAEEITNIMKDFDEPGHLAPTGLFLAGTKYMVIQGEPGAVIRGKKGPGGITIKKTAQALIFGVYEEPVTPGQCNMVVEKIGDYLVDQGY

SEQ ID NO: 684 - protein, 412 aa, Solanum lycopersicum
MSVALLWVVSPCDVSNGTSFMESVREGNRFFDSSRHRNLVSNERINRGGGKQTNNGRKFSVRSAILATPSGERTMTSEQMVYDVVLRQAALVKRQLRSTNELEVKPDIPIPGNLGLLSEAYDRCGEVCAEYAKTFNLGTMLMTPERRRAIWAIYVWCRRTDELVDGPNASYITPAALDRWENRLEDVFNGRPFDMLDGALSDTVSNFPVDIQPFRDMIEGMRMDLRKSRYKNFDELYLYCYYVAGTVGLMSVPIMGIAPESKATTESVYNAALALGIANQLTNILRDVGEDARRGRVYLPQDELAQAGLSDEDIFAGRVTDKWRIFMKKQIHRARKFFDEAEKGVTELSSASRFPVWASLVLYRKILDEIEANDYNNFTKRAYVSKSKKLIALPIAYAKSLVPPTKTASLQR

SEQ ID NO: 685 - protein, 538 aa, Solanum lycopersicum
MANDLQVLNALDVAKTQLYHFTAIVIAGMGFFTDAYDLFCISMVTKLLGRLYYHHDGALKPGSLPPNVSAAVNGVAFCGTLAGQLFFGWLGDKMGRKKVYGMTLMIMVICSIASGLSFGHTPKGVMTTLCFFRFWLGFGIGGDYPLSATIMSEYANKKTRGAFIAAVFAMQGFGILAGGMVAIIVSAAFKGAFPAPAYEVDAIGSTVPQADFVWRIILMFGAIPAGLTYYWRMKMPETARYTALVAKNLKQAANDMSKVLQVEIEAEPEKVTAISEAKGANDFGLFTKEFLRRHGLHLLGTASTWFLLDIAFYSQNLFQKDIFSAIGWIPPAQTMNALEEVYKIARAQTLIALCSTVPGYWFTVAFIDKIGRFAIQLMGFFFMTVFMFALAIPYHHWTLKDHRIGFVVMYSFTFFFANFGPNATTFVVPAEIFPARLRSTCHGISAAAGKAGAMVGAFGFLYAAQPTDPTKTDAGYPPGIGVRNSLIVLGCVNFLGMLFTFLVPESNGKSLEDLSRENEGEEETVAEIRATSGRTVPV

SEQ ID NO: 686 - protein, 528 aa, Solanum lycopersicum
MAVGDNDNNNLQVLNALDLAKTQLYHFTAIVIAGMGFFTDAYDLFSISLVTKLLGRLYYTKPDLLKPGTLPPAVSASVTGVALVGTLAGQLFFGWLGDKMGRKKVYGMTLVLMVVCSVASGLSFGSTPKGVMTTLCFFRFWLGFGIGGDYPLSATIMSEYANKKTRGAFIAAVFAMQGFGILFSGIVALITAAGFDHAYRSPTFEENAALSTVPQSDYIWRIILMFGSLPAALTYYWRMKMPETARYTALVAKDAKRAAQDMGKVLQVEIESEEAKIEQISRNETNQFGLFSWEFVRRHGLHLFGTCSTWFLLDIAFYSQNLFQKDVFSAVGWIPKAPTMNAVQEVYKIARAQTLIALCSTVPGYWFTVAFIDIIGRFAIQLMGFFFMTVFMFAIAIPYHHWTLEANRIGFIVMYSLTFFFANFGPNATTFVVPAEIFPARLRSTCHGISAAAGKAGAIVGAYGFLYAAQSKDPNKTDAGYPAGIGIKNSLIVLGCINALGMLCTFCVPEPKGKSLEEASQETITGEA

SEQ ID NO: 687 - protein, 171 aa, Solanum lycopersicum
METKSTENCKDEEQKNHYYYSNSTSPGLLSSLEDEEIKRKICCHSLYGLLVQTHLDCLKVCLGITEIDKIDQKTEEKSAKCNKVISHTMDHQTELNNKFSSLTMDQPAELDNFMEAYCVALSKLKEAMEEPHLESIKFINHMYSQLSELMELPTSTSTPSNFDGMKAHGNK

SEQ ID NO: 688 - protein, 218 aa, Solanum lycopersicum
MAGYRGDDEYDYLFKLVLIGDSGVGKSNLLSRFTKNEFNLESKSTIGVEFATKSLNIDGKVIKAQIWDTAGQERYRAITSAYYRGAVGALLVYDVTRHVTFENVNRWLKELRDHTDPNIVVMLLGNKSDLRHLVAVSTEEAKSLAEREALYFMETSALEATNVENAFTEALTQIYRIVSKKAVEAGDEGATSTAPPKGQTINIKDEGSAWKKFGCCSS

SEQ ID NO: 689 - protein, 203 aa, Solanum lycopersicum
MNPEYDYLFKLLLIGDSGVGKSCLLLRFADDSYLESYISTIGVDFKIRTVDQDGKTIKLQIWDTAGQERFRTITSSYYRGAHGIIVVYDVTDQESFNNVKQWLSEIDRYASDNVNKLLVGNKCDLTAQKVVSTETAQAFADEIGIPFMETSAKNATNVEQAFMAMAASIKNRMASQPASNNARPPTVQIRGQPVNQKSGCCSS

SEQ ID NO: 690 - protein, 989 aa, Solanum lycopersicum; identical to SEQ ID NO: 601

SEQ ID NO: 691 - protein, 96 aa, Solanum lycopersicum
MAKSGYNASFLLLISMFLILLTFSNVVEGYNKLRPTDCKPRCTYRCSATSHKKPCMFFCQKCCATCLCVPKGVYGNKQSCPCYNNWKTQEGKPKCP

SEQ ID NO: 692 - protein, 358 aa, Solanum lycopersicum
MASSNRHWPSMFKSKPCNSHHHQWQHDINSSIIQQRPPCNPEERSPEPKPRWNPRPEQIRILEAIFNSGMVNPPRDEIRKIRAKLQEYGQVGDANVFYWFQNRKSRSKHKQRHLQAKAQQQHHNNNNNSSHQPIITSSSSSSDKSSPNSLTFSIGTSNVMDLLNSPTSSVNQQNYNEFLSNEQPFFFTVQPPPVVPTHDHSAGFCFQDSSTFTPHSSSSGLLLNEWMGGISTQAPNNSKKDENDKINLQSQLMSYTVTSTVSPLATTTIPTISHIQGVTVDPNDAGPTRSTVFINDVAFEVGIGPFNVREVFGEDAVLIHSSGEPLITNEWGITIQPLQHGAFYYLLRTSSIASTHHI

SEQ ID NO: 693 - protein, 360 aa, Solanum lycopersicum
MEMDLPVSAIGFEGFEKRLEISFVEPGLFADPNGKGLRSLTKAQLDEILGPAECTIVDNLSNDYVDSYVLSESSLFVYSYKIIIKTCGTTKLLLAIPPILRLAETLSLKVQDVRYTRGSFIFPGAQSFPHRHFSEEVAVLDGYFGKLAAGSKAVIMGNPDKTQKWHVYSASAGTVQCNDPVYTLEMCMTGLNREKASVFYKTEESSAAHMTVRSGIRKILPKSEICDFEFEPCGYSMNSIEGAAVSTIHITPEDGFSYASFESVGYDPKTNELGPLVERVLACFEPAEFSIALHADVATKLLEHVCSVDVKGYSLAEWSPEEFGKGGSIVYQKFTRTPYCESPKSVLKGCWKEEEKEGKE

SEQ ID NO: 694 - protein, 394 aa, Solanum lycopersicum; identical to SEQ ID NO: 602

SEQ ID NO: 695 - protein, 177 aa, Solanum lycopersicum
MPRERDPLVVGRVVGDVLDPFTRTIGLRVIYRDREVNNGCELRPSQVINQPRVEVGGDDLRTFFTLVMVDPDAPSPSDPNLREYLHWLVTDIPATTGSSFGQEIVSYESPRPSMGIHRFVFVLFRQLGRQTVYAPGWRQNFNTRDFAELYNLGLPVAAVYFNCQRESGSGGRRRSAD

SEQ ID NO: 696 - protein, 1106 aa, Solanum lycopersicum
MVAQIETNAAADGGGGGGGGGMVGGSSPPVDESQEQLEKTKTLICALNFLSRNLPIPPDVFDAVSSIYNSDANDVDVGDGDASPADVDSLSVQNGPGMGSYGDLMADLEESLLSQRSSYTSGSGLTKLKEDRFRSHIQHRLTELEDLPTSRGEDLQSKCLLELYELKLADLQQKVRSEVSSEYWLRLHCANPDKQLFDWGMTRLRRPVYGIGDAFAVESDDPLRKKRDAQRLSRIEEEERNRVETTKRKFFADVLNAARELQLQVQAVQKRRKQRNDGVQAWHGRQRQRATRAEKLRLQALKADDQEAYMKMVEESKNERLTMLLGKTNDLLGRLGAAVQRQKDADHDGLESLEGSDAEMAATKTDTPGQSLPEEEEDVIDDESTHDVKTNDLLEGQRKYNSAVHSIQEKVTEQPAMLQGGELRSYQIEGLQWMLSLFNNNLNGILADEMGLGKTIQTIALIAYLLENKGVRGPHLIVAPKAVLPNWITEFSTWAPSIVAILYDGRLEERKALREELTGEGRFSVLITHYDLIMRDKAFLKKIHWHYLIIDEGHRLKNHECALARTLVSGYRIRRRLLLTGTPIQNSLQELWSLLNFLLPNIFNSVENFEEWFNAPFADKCDVSLTDEEELLIIRRLHHVIRPFILRRKKDEVEKFLPGKTQVVLKCDMSAWQKVYYQQVTDVGRVGLDSGTGRSKSLQNLSMQLRKCCNHPYLFVAEYNIYRKEEIVRASGKFELLDRLLPKLRRAGHRVLLFSQMTRLMDILEVYLQVHDFKYLRLDGSTKTEERGTLLKQFNAPDSPYFMFLLSTRAGGLGLNLQTADTVIIFDSDWNPQMDQQAEDRAHRIGQKKEVRVFVLVSVGSIEEVILERAKQKMGIDAKVIQAGLFNTTSTAQERRDMLEEIMRKGTSTLGTDVPSEREINRLAARSDEEFWLFEKMDEERRQKERYRSRLMEDHEVPDWAYATPDSKEKGKGFLYESANITGKRRRKEVVYADTLSDVQWMKAVENGDDFFTQSSKGRNRDHQSVSNGELPSGNADSERTGHDLKPDTVSVASEATSEDTYGRTPKRFKSESASSMRNDYHDLTGHSVDGLSWKAHRRRRSSLIS

SEQ ID NO: 697 - protein, 162 aa, Solanum lycopersicum
MSRPQQKYRGVRQRHWGSWVSEIRHPSLKTRIWLGTYETSEDAARAYDEAARLMCGSTARTNFPYNATESSRFLSSALIAKLQRCNMSSLTATSRRPGKTRLEDKKENEISTLVRDTGDGEERQSESASQQYMKALEDEHIEQMIEELLDYGSIEMCSVRNE

SEQ ID NO: 698 - protein, 769 aa, Solanum lycopersicum
MKGMPLPFEFEGKGVLELDVLFNKDSILNSWSNHNTSKESSSCCYFVNSPSAVLDTIRSPRPINSSSTLSSSLGGGGGGGGTASTDTAGGGVAAVSANPSSKWQQQQQDNTTATSSNVGAESELQQVQPPSSLEMGAAATGGDKCAMEEWEGGLSESVMASPCQEQSILRWIMGDVDDPSMANLNKVLQVSGTGDYEFNGGFGVVDQGFGVDPVGQIGSFMPAISSSVSMSSSSFPTNRMNSDKIGLVSNPPTNLPQNPIFPSLSNNLGPIAFGQTQQQPFESTDLKPHAFNSQFLINQHQTQIPQNPSFLLPLPFAQQEQNLALPPQAKRHNPGTMGGLEPGSQISKGLFLDAGHQQPTPSQGLAHQLQLLPHFRPGAMGTKPKMVGEEMAQFHQLQQQQQQQQQAIIDQLFKAAELVQTGNPVLAQGILARLNHQLSPIGKPFYRAAFYCKEALQLLLHANTNNLNPSMASSPFSLIFKIGAYKSFSEISPVAQFANFTCNQALLEVLDGFERIHIVDFDIGYGGQWASLMQELALRSGGAPTLKITALASPSTHDQLELGLTRENLIHFASEINMAFEFEILSIDSLNSTSWSLPPLVSENEAIAVNLPVSSLSSYQLSLPLVLRFVKQLSPRIVVSVDRGCDRTDLPFPNHVIQALQSYSNLLESLDAVNVNFDALQKIERFLLQPGIERIVMGRFRSPEKTQHWRSLFLSSGFAPLSLSNFTESQAECVVKRTPVRGFHVEKRQSSLVLCWQRKELISASAWRC

SEQ ID NO: 699 - protein, 701 aa, Solanum lycopersicum
MIVIPQSNNLPAKGVLGVSGFVPSISSSSSPEASICKKDANFTRNEPVSVLDTRSPSPSASSSSCSYGAQHGGNTAVPGVGSGKTDGRKEELVTELEPFTVGLEPEKSVLGFGDLDNLLPEFAGSDQSFLRWISGDVEDPSVSLKQLLNGDLGCGVSLQSSGFEVSATGSLAHSDNVSFSGSNICLNANIEKLSSVIDSINSRNNNFENPNVNPSLEQKPQPFGPQVMANQTQFQNAACVNIFGSSSYDINQEQPPPKRHNSGTLGGALLPKVPFFDANCDFMLRKQPLGQMQPQVNLLPPHQFQPKPLIVPKLEAAGGGGNGNLMVPRHQLQEQQFIYDQIFQASELLLAGQFSNAQMILARLNQQLSPIGKPSRRAAFYIKEALQLPFLLPCTSTFLPPRSPTPFDCVLKMDAYKAFSEISPLIQFMNFTSNQAILEALGDAEQIHIIDFDIGFGAQWSSFMQELPSSNRKATSLKITAFASPSTHHSIEIGIMHESLTQFANDAGIRFELEVINLDSFDPKSYPLSTLRSSECEAIAINFPIWSISSCPFAFPSLLHCMKQLSPKVVVSLERGCERTELPLKHHLIHALQYYETLLASIDAANITPDIGKKIERSLFQPSIENMILGRLRSSDRMPPWRNLFASAGFSPVAFSNMTEIQAECVVKRTQVGGFHVQKRQTSLVLCWKQQELLSAVTWRC

SEQ ID NO: 700 - protein, 349 aa, Solanum lycopersicum
MSPPLLGVGEEEGQSNVTLLASSTSLGSICIKGSALKERNYMGLSDCSSVDSCNISTSSEDNNGCGLNLKATELRLGLPGSQSPERGEETCPVSSTKVDEKLLFPLHPSKDTAFSVSQKTVVSGNKRGFSDAMDGFSEGKFLSNSGVKAGDTKETSRVQPPKMKDANTQSTVPERPSAVNDASNRAGSGAPATKAQVVGWPPIRSFRKNTLASASKNNEEVDGKAGSPALFIKVSMDGAPYLRKVDLRTCSAYQELSSALEKMFSCFTIGQYGSHGAPGKDMLSESKLKDLLHGSEYVLTYEDKDGDWMLVGDVPWEMFIDTCKRLRIMKGSDAIGLAPRAMEKCRSRN

SEQ ID NO: 701 - protein, 417 aa, Solanum lycopersicum
MSSTSSSCSCSPMGTSMGMFFADMNSLSINTPESLDEGKGRRGSWDFQFLNKGGSFFSSRSLDEAQNSEENNESIDLNASCFNDEKQITMHTTFNSNNNSSSSGCNGKETENGQSKLCARGHWRPAEDAKLKELVAIYGPQNWNLIAEKLEGRSGKSCRLRWFNQLDPRINRRAFSEEEEERLMAAHRLYGNKWAMIARLFPGRTDNAVKNHWHVIMARKYREQSSAYRRRKMGQFVYRRSTTTVVEEADNSSGQNSVNHFSMKMNNNNGPNGWVVYGPNGSPHMAASAGEAATPSSTNNVPLYSPYSPFAAPPFDSLPAGHCGNEMINVLNQQGGRSWDRQREVTHQHPSNSLMMMNNMQQDQSQYVLQFPYVTQISSSPSTTEQGLVKEDKRSNNNSDNTTIAPPFIDFLGVGAT

SEQ ID NO: 702 - protein, 288 aa, Solanum lycopersicum
MATPSLQSPIAKKLEGKIAIITGGASGIGLATARLFIQHGAKVTIADIQDDLVNSLVKENEHLMFVHCDVAIESDVQNVVDATVAKFGKLDIMFSNAGVAGKSISSILDVDTDIIKNVFDVNVVGAFLCAKHAARVMISSHTKGSIIFTTSAATVVYGIVPHSYAASKSAVLGLCKNIGVELGRYGIKVNCVSPHYISTKLALDALGIDEREKAERWFGEGGNLKGVLLEEQDVANGVLYLASDDSKYVSGLNLVIDGGYSTTNVALGEAYKKLFPSGTTNQVMQILI

SEQ ID NO: 703 - protein, 163 aa, Solanum lycopersicum
MSYEPNTALNLSLSRNDLLFDQSSSSSSSTPLSPVEPRVFSCNYCRRKFYSSQALGGHQNAHKLERTLAKKSRELSSTLRGPHSSWSNHSNSNNNSNSNNHCSLSPSGPSHTSHGHGHGARFVTNNDLISYGRREMMMSYESMKNGHESVQEDFGHLDLSLRL

SEQ ID NO: 704 - protein, 175 aa, Solanum lycopersicum
MASKMCEPLVIGRVIGEVVDYFCPSVKMSVVYNNNKHVYNGHEFFPSSVTSKPRVEVHGGDLRSFFTLIMIDPDVLGPSDPYLREHLHWIVTDIPGTTDCSFGREVVGYEMPRPNIGIHRFVFLLFKQKKRQTISSAPVSRDQFSSRKFSEENELGSPVAAVFFNCQRETAARRR

SEQ ID NO: 705 - protein, 181 aa, Solanum lycopersicum
MANMETSARSVDPLVVGKVIGDVLDMFVPVVDFTVEYASKQISNNGVEIKPAEAAQKPRVHIKGSLHSNNLYTLVMADPDAPSPSEPTFREWLHWIVTDIPEGGDASQGREMVEYMGPKPPAGIHRYVFTLFRQKEAEQVPHKPPQGRSNFKTRQFASDNGLDLPVAALYFNSQKEHAAHH

SEQ ID NO: 706 - protein, 175 aa, Solanum lycopersicum
MPRDPLIVSGVVGDVVDPFTRCVDFGVVYNNRVVYNGCSLRPSQVVNQPRVDIDGDDLRTFYTLIMVDPDAPNPSNPNLREYLHWLVTDIPAATGATFGNEVVGYESPRPSMGIHRYIFVLYRQLGCDAIDAPDIIDSRQNFNTRDFARFHNLGLPVAAVYFNCNREGGTGGRRL

SEQ ID NO: 707 - protein, 159 aa, Solanum lycopersicum
MLTAPSLSRFKSPFISSPLKLPTLSSSFFTQKFHQTCRRRNSYPCIKAVDLDQNTVIAITVGVLSVAIGVGIPVFYETQIDNAAKRENTQPCFPCTGTGAQKCRFCMGTGSVTVELGGGETEVSRCINCDGAGGLTCTTCQGSGIQPRYLDRREFKDDD

SEQ ID NO: 708 - protein, 352 aa, Solanum lycopersicum
MATSLQFSSDHHPIPQENHQTTNQTSTGGRRRSSKNGQKKKKQPQRGMGVEQLERLRVQDQMKNSTIHGVHHNHQYYSNNNFPKLTPVSSFTGGGSASADPGNYSNSILNSSPVLQFPKLCAVSPNDFFMQQKVVNTGFIGSSSTNQLMISSHDHHQFQSQMNLYGFATSKPSTEKSKELYPMPNLFSSNNSCFSDRCRSCNKKKRMINGEEISVHMEDMIREKEDSGTKPLLHSYSLPSHQQKGVEIVAIHRKGSSSALSSDEGAVMMEYDFFPEKISSKSTNTYKSCFENEATMMSAYNSPESSSFAAAAAAAGNIINGEASSVTTISWAADTTTTSPTSSIDLSLKLSC

SEQ ID NO: 709 - protein, 421 aa, Solanum lycopersicum
MGKRRNWFTFVKRLFIPETESTADQKKPKRWRCCFLRKFKLRKCPAITSAPQQTLPEAKGTPQQTLTEAKEQQRKHAFAVAIATAAAAEAAVAAANAAADVIRLTDAPSEFKRKRKQAAIRIQSAYRAHLAQKALRALKGVVKLQAVIRGEIVRGRLIAKLKFMLPLHQKSKTRVNQIRVPTFEDHHDKKLINSPREIMKAKELKLKCKSLSTWNFNLASEQDSEALWSRREEAIDKREHLMKYSFSHRERRNDQTLQDLLNRKQNRRSYRIDQLVELDAPRKAGLLEKLRSFTDSNVPLTDMDGMTQLQVRKMHRSDCIEDLHSPSSLPRRSFSNAKRKSNVDDNSLPSSPIFPTYMAATESAKAKTRSNSTAKQHLRLHETLSGQHSPYNLKISSWRLSNGEMYDSARTSRTSSSYMLI

SEQ ID NO: 710 - protein, 269 aa, Solanum lycopersicum
MVFPINQELLVDESSSQLRKTSGGTGGGGRGKIEIKRIENTTNRQVTFCKRRNGLLKKAYELSVLCDAEVSLIVFSSRGRLYEYANNSVRATIDRYKKHHADSTSTGSVSEANTQYYQQEASKLRRQIRDIQTYNRQIVGEALGSLSPRDLKNLEGKLEKAIGRVRSKKNELLFSEIELMQKREIELQNANMYLRAKIAEVERAQEQMNLMPGGGGGGGGGGGGGSDHQYHHQPNYEDARNNFLPVNLLEPNPHYSRRDNGDQTPLQLV

SEQ ID NO: 711 - protein, 392 aa, Solanum lycopersicum
MSPFAIFFLLLINSSLAANTNIYNVQNYGAKSDGKTDSSKAFLNAWAAACASNKPSTINVPIGKYLIHNANFNGQTCKSKAITMHIDGTLLAPSDYNVIGNEENWIKFEKVNGLSIYGGTFDGQAAALWACKNSNNKNCPDGTTALTFYNSNNIIMSGVKVQNSQKFQILVDGCHNVKLQGVKVSAPGNSPNTDGIHVKSSSGVSIMKSQIGTGDDCISIGPGTSNLWIEGIACGPGHGISIGSLGWKQQELGVQNVTVKTVTFSGTTNGVRVKTWARPSNGFVRNVLFQHIVMVNVKNPIIIDQNYCPNHQSCPHKGSGIKISDVTYQDIHGTSATEVAVKLDCSKSNPCSGITLEDVNLSYQNQQTEASCVNARGRVSGLQKPTNCLLKS

SEQ ID NO: 712 - protein, 392 aa, Solanum lycopersicum
MSPLAIFFLFLINSSLAANTNIYDVQNYGAKSDGKTDSSKAFLNAWAAACASNTPSTINVPAGKYLIHNANFNGQTCKSKAITMHIDGTLLAPSDYNVIGNEENWIKFEKVNALSIYSGTFDGQGASLWACKNPNNKNCPDGTTALTFYNSNNIIMSGVTVQNSQKFQILVDGCRNVKLQGVKVSAPGNSPNTDGIHVKLSSGVSIINSHIGTGDDCISIGPGTSNLWIEGIACGPGHGISIGSLGWKQQELGVQNVTVKTVTFSGTTNGVRVKTWARPSNGFVRNILFQHIVMVNVKNPIIIDQNYCPNHESCPHQGSGIKISDITYQDIHGTSATKIAVKLDCSKTNPCSGITLEGVNLSYQNQQTEASCVNARGRVSGLQKTTNCLLEN

SEQ ID NO: 713 - protein, 387 aa, Solanum lycopersicum
MSPLAIFFFFFFNLSLATNTIYNVQNFGAQSNGKIDSTKAFLSAWGSACASTSASTIYVPRGNYLIRNIYFNGQTCKSNAIAIHIDGTLLAPSDYNAIDNDGSWIKFEKVNRVSIYGGIFDGQGASLWACKNSKKNCPKGTTALAFYNSNNIVMSGVTVQNSQMFHILVDGCHNAMIQGVKVLSPGNSPNTDGIHVQSSSGVSIMNSNIGTGDDCISIGPGNSNLWIEGIACGPGHGISIGSLGWESQEQGVQNVTVKMVSFTSTENGVRVKTWARPSNGFVRNVLFQHIVMSNVQNPIIIDQNYCPNHESCPNQGSGVKISDVTYEDIHGTSATEIAVKLDCSKTNPCSGITLEDVNLSYKNGRAEASCVNAGGRASGFEELSKCL

SEQ ID NO: 714 - protein, 689 aa, Solanum lycopersicum
MVYKKKLDFGFNGFQVPVIPKAPRSVRRRRSCKKLDDDQICAFELLAAVAGKLLLESESSTSSNAAEGKNEIADGRDGIKSEQVEEGKAVKSECLDQGSCVESDYLPDTAVQDQNLKHGFDKPHHAENNYFLEHTSTVIGSDADLKLENCKEVNITDGKFHHKIEGGSSSLEDPCDSKIRTGTQKHLDDDSKQIEDVTVTNTCSVKNPIKECVNNSGLFNSDGSVQLPLYRDSVPSASFVKQRNSVKLGVRDDDENSFDCYRYSTKLRAFRTTSRLGYRRIRKMLKSRHWKVAPKLKEYERSYTNGGMESFYLSRKSVRARKRCQLEVPSKRRKLSNHGFAVAYYQEASSESVTNSPDKEIKRDISTSHAIPPRGTADPASVNNHHKKDPNVKFSIKSFKVPELYIEVPETATVGSLKRTVMEAVTAILESGLRVGVVLQGKKVRDDNRTLEQAGISQNGNLDNLGFTLEPRFTQVSPSSSPNKLPASSTYVADQELTRRRPSPIMEFGIHNASADPLETDMCKYSENNHPSELSPTNPIDSSTDVSIPDSRALVIVPSVNAEALAMVPLNHKSKRSELSQRRIRRPFSVAEVEALVEAVEHLGTGRWRDVKMRAFDNADHRTYVDLKDKWKTLVHTASIAPQQRRGEPVPQELLDRVLAAHAYWSQQQGKHHAELLKTPDAKAQKVSA

SEQ ID NO: 715 - protein, 168 aa, Solanum lycopersicum
MLVYQDLLTGDELLSDSFPYKEVENGVLWEVQGKWVVQGAVDVNIGANPSAEGGCEDEGVDDQAVRVVDIVDTFRLQEQPAFDKKQFVTFMKRYIKNLTPKLEGETQEAFKKNIEAATKFLLQKIKDLQFFVGESMHDDGALVFAYYKEGSADPTFLYIAPGLKEIKC

SEQ ID NO: 716 - protein, 245 aa, Solanum lycopersicum
MGRGRVQLKRIENKINRQVTFSKRRSGLLKKAHEISVLCDAEVGLIVFSTKGKLFEYANDSCMERILERYERYSFAEKQLVPTDHTSPVSWTLEHAKLKARLEVLQRNQKHYVGEDLESLSMKELQNLEHQLDSALKHIRSRKNQLMHESISVLQKKDRALQEQNNQLSKKVKEREKEVAQQNQWEINSSSFVLPQQLDSPHLGEAYQSTNVIDNGEVEGGSSSQQQGAANNTVMPQWMLRHLNN

SEQ ID NO: 717 - protein, 241 aa, Solanum lycopersicum
MGRGRVELKRIENKINRQVTFAKRRNGLLKKAYELSVLCDAEVALIIFSNRGKLYEFCSSSSMLKTLERYQKCNYGAPEPNISTREALEISSQQEYLKLKGRYEALQRSQRNLLGEDLGPLNSKELESLERQLDMSLKQIRSTRTQLMLDQLTDYQRKEHALNEANRTLKQRLMEGSQLNLQWQPNAQDVGYGRQTTQTQGDGFFHPLDCEPTLQIGYQNDPITVGGAGPSVNNYMAGWLP

SEQ ID NO: 718 - protein, 225 aa, Solanum lycopersicum
MGRGKIEIKKIENSTNRQVTYSKRRNGIFKKAKELTVLCDAKISLIMLSSTRKYHEYTSPNTTTKKMIDQYQSALGVDIWSIHYEKMQENLKRLKEINNKLRREIRQRTGEDMSGLNLQELCHLQENITESVAEIRERKYHVIKNQTDTCKKKARNLEEQNGNLVLDLEAKCEDPKYGVVENEGHYHSAVAFANGVHNLYAFRLQPLHPNLQNEGGFGSRDLRLS

SEQ ID NO: 719 - protein, 225 aa, Solanum lycopersicum
MENNHQTQIQTTKTSRFKRICVFCGSSPGKKPSYQLAAIQLGNQLVERNIDLVYGGGSVGLMGLVSQSVFNGGRHVLGVIPKTLMPREITGESVGEVRAVSGMHQRKAEMARQADAFIALPGGYGTLEELLEVITWAQLGIHDKPVGLLNVDGYYNSLLSFIDKAVDEGFVTPSARHIIISAPTAQELMSKLEDYVPKHNGVAPKLSWEMEQQLGYTTTKLEIAR

SEQ ID NO: 720 - protein, 246 aa, Solanum lycopersicum
MGRGRVELKRIENKINRQVTFAKRRNGLLKKAYELSVLCDAEVALLVFSNRGKLYEFCSTNNMLKTLDRYQKCSYGTLEVNRSIKDNEQSSYREYLKLKAKYESLQRYQRHLLGDELGPLTIDDLEHLEVQLDTSLKHIRSTRTQMMLDQLSDLQTKEKLWNEANKVLERKMEEIYAENNMQQAWGGGEQSLNYGQQQHPQSQGFFQPLECNSSLQIGYDPITTSSQITAVTNAQNVNGMIPGWML

SEQ ID NO: 721 - skipped

SEQ ID NO: 722 - protein, 510 aa, Solanum lycopersicum
MERKTPNRTRRKQRSNQKSKKRMNKGSLSRHFTVGIAKPPLPNQQQLHSSLSNVTLPNPSRFQKLLDSDDLPPAQSQFSSVLPLNLDADDDADVADVAEKDFILSQDFFCTPDYLTPDAPAICNGLDGDKDDYTPCPKSPEKLLSVSRKRPRLASVRPFSSDLSGQQQPVDIPTDTFGTDEMKSEKISESEKGPSYVSQSAIALRYRVMPPPCIRNPYLGDASEIDADPFGNRRSKYPGFNPAISGNDGLSRYRTDFHEIEQIGSGNFSRVFKVFKRIDGCMYAVKHSTKQLHQDTDRRQALMEVQALAALGPHENVVGYYSSWFENEHLYIQMELCDHSLSNKKYCKLFSEVEVLEAMYQVANALQFIHQRGVAHLDVKPDNIYVKNGVYKLGDFGCATLLDKSQPIEEGDARYMPQEILNENYDHLDKVDIFSLGAAIYELIRGSSLPESGPHFLNLREGKLPLLPGHSLQFQNLLKAMMDPDPTRRPSAKGVVDNPIFERWQRNSNK

SEQ ID NO: 723 - protein, 273 aa, Solanum lycopersicum
MMEHQHNIEDGGKNSNNSFLCRQSSSRWTPTSDQIRILKDLYYNNGVRSPTAEQIQRISAKLRQYGKIEGKNVFYWFQNHKARERQKKRLIAAASATDNNNISSMQMIPHLWRSPDDHHKYNTATTNPGVQCPSPSSHGVLPVVQTGNYGYGTLAMEKSFRECSISPPGGSYHQNLTWVGVDPYNNMSTTSPATYPFLEKSNNKHYEETLDEEQEEENYQRGNSALETLSLFPMHEENIISNFCIKHHESSGGWYHSDNNNLAALELTLNSFP

SEQ ID NO: 724 - protein, 231 aa, Solanum lycopersicum
MAAAEMERTMSFDAAEKLKAADGGGGEVDDELEEGEIVEESNDTASYLGKEITVKHPLEHSWTFWFDNPTTKSRQTAWGSSLRNVYTFSTVEDFWGAYNNIHHPSKLIMGADFHCFKHKIEPKWEDPVCANGGTWKMSFSKGKSDTSWLYTLLAMIGHQFDHGDEICGAVVSVRAKGEKIALWTKNAANETAQVSIGKQWKQFLDYSDSVGFIFHDDAKRLDRNAKNRYTV

SEQ ID NO: 725 - protein, 221 aa, Solanum lycopersicum
MADELNKAALEEYKSSSVEDRGEEGEIVGESDDTASSLGKQITMKHPLEHSWTFWFDNPSGKSKQAAWGSSIRPIYTFSTAEDFWSVYNNIHHPSKLAVGADFHCFKNKIEPKWEDPVCANGGKWTMNFSRGKSDTCWLYTLLALIGEQFDYGDEICGAVINVRVRQEKIALWTRNAANETAQVSIGKQWKEFLDYNDTIGFIFHDDAKKLDRAAKNRYSV

SEQ ID NO: 726 - protein, 240 aa, Solanum lycopersicum; identical to SEQ ID NO: 566

SEQ ID NO: 727 - protein, 392 aa, Solanum lycopersicum
MLSVVFENMGSLCSRNKHYSQADDEENTQTAEIERRIEQETKAEKHIQKLLLLGAGDSGKSTIFKQIKLLFQTGFDEEELKNYIPVIHANVYQTTKILHDGSKELAQNELEASKYLLSAENKEIGEKLSEIGGRLDYPHLTKDLVQDIEALWKDPAIQETLLRGNELQVPDCAHYFMENLERFSDVHYIPTKEDVLFARIRTTGVVEIQFSPVGENKKSGEVYRLFDVGGQRNERRKWIHLFEGVTAVIFCAAISEYDQTLFEDERKNRMMETKELFEWVLKQPCFEKTSFMLFLNKFDIFEQKVPKVPLNACEWFKDYQSVSTGKQEIEHAYEFVKKKFEESYFQCTAPDRVDRVFKIYRTTALDQKLVKKTFKLVDETLRRRNLFEAGLL

SEQ ID NO: 728 - protein, 301 aa, Solanum lycopersicum
MSQRTAPAPFLLKTYQLVDDATTDDVISWNEIGTTFVVWKTAEFAKDLLPKYFKHNNFSSFVRQLNTYGFRKIVPDKWEFANENFKRGQKELLTAIRRRKTVTSIPAGGKSVAAGTSASPDNSGDDIGSSSTSSPDSKNPGSVDTPGKLSQFTDLSDENEKLKKDNQMLSSELVQAKKQCNELVAFLSQYVKVAPDMINRIMSQGTPSGSSLEELVKEVGGVKDLEEQGSYNDNDDKEDDDEKGDTLKLFGVLLKEKKKKRGPDDNIETCGGRGKMMKTVDYNGPWMKMSSTAGESSKVCN

SEQ ID NO: 729 - protein, 242 aa, Solanum lycopersicum
MAREKIQIKKIDNSTARQVTFSKRRRGLFKKAEELSVLCDADVALIIFSSTGKLFDYSSSSMKQILERRDLHSKNLEKLDQPSLELQLVENSNYSRLSKEISEKSHRLRQMRGEELQGLNIEELQQLERSLETGLSRVIERKGDKIMREINQLQQKGMHLMEENEKLRQQVMEISNNNNNNNNGYREAGVVIFEPENGFNNNNNEDGQSSESVTNPCNSIDPPPQDDDSSDTSLKLGLPYSG

SEQ ID NO: 730 - protein, 1805 aa, Solanum lycopersicum
MSHNQSRADTRESSQYRRTARSGSFNQHRGGRGSGGGGGGAAPPPVSSTSNPSLTSNRSFNKKYYNAQGGQPRVSGVGAGSDSHLNGAHQQQPSHGVSDVSVAIAHTPLPSATVKPTDASTQKVTRAVPRAPTSNVVPPISESSAPVTPAKNPGDASKSFPLQFGSISPGVMNVLQIPARTSSAPPNLDEQKRAQARGDTSRAIPSLPNPSTSKQPMPRKDAGPLNQSNHSEAYGVANKPKRDVHILAPPPVTQTQKPSTHPMPGMHMQIPFHQPPQVPVQFGGPGPQIPSHSMSATSLPMPMHLPIVNPPMQQPMFVSNLQPHPMQSQGMMHQGQGLNFSSGIGAQLPQQLGNMGMNMPSQFSPQQAGKFLGQRKSVKITHPETHEELRLEERSHPNMPPQSQPIASYSPSHPNYYPNSYNSNSVYFQAPSSIPLSNTQSSQPPRPFNQVTVKPAAGGIHSGKEQLPSVSSSFGKDPVRLSKPCGGDSAHSQKDANTSHQSSTTQSRTGDGSKSSSRPVENIQSTKGADSISGKSSAAGILSLTSQAPIESSTSLIRDSSVDAASETLGGPDSTEDQKKKQVTRGQLTVQDKALGKCTSVSIQTPQYPLTTLVEVNTAASVSTAVNTRESLSLSESAELRSHITGNCGKEDLSEPLDSRNQDAGKPVLKTGDRNEVALSKAGKQDENNSLKPPSESLPVESPEVSGLTEGGSPKRAAYANIENGRPEIGVEHMNESVACSTGVDSIADSFTSSTSNQDSTNTEACTSAIGLSAQDDQESDIADPEEAPVTKSVDASQEFASDLLKSSDEATSKSEDENTETSNAGLVSKSSSGVKEKSLVDSNVPKVTMSRGKKKKKDLYKKADAAGATSDLYMAYKGPEKKDELSQSIETIELTSKDDSMPPSANVHQEDLRSTKKVGEVKAEPDDWEDAADVSTPKLEIAPEHRKVDGEDGDGVTTKKYSRDFLLKFAEQCIDIPEGFNVAPDVADILINFNASAMREPFPSPGRGTDRPSSGHRERRGSGVGDGDKWNKMPGPPMPGRDFQPDIGFGGNGVGFRPGPGGNSGVLRHPRGAMPIQYAMGQYAVGQYAMGQLATGGILSGPMQSMGPPQGGGLRNGVDADRWQRGTAFQKGLMPSPHTPAQNMHKAEVKYEVGKVTDEEQAKQRQLKAILNKLTPQNFDKLFQQVKEVNIDNYVTLKGVISQIFDKALMEPTFCEMYANFCQHLAAELPDLSVDNEKITFKRLLLNKCQEEFERGEREELEANVTNEEGEVKLSAEEREEKRVKARRRMLGNIRLIGELYKKKMLTERIMHECIKKLLGDYQNPDEENVEALCKLMSTIGEMIDHAKAKEHMDAYFDMLEKLSNNMKLSSRVRFMLKDSIDLRKNKWQQRRKVEGPKKIEEVHRDAAQERHAQATRLARTPSLGGSSRRGQPMDFVPRGGGMLSSPGSQMGGFRPMSPQVRGYGMQDVRVDERHSFENRTLSLPLTQRPLGDDPITLGPQGGLAKGMSSRGQPAGPSIDNMSSFGDSRRMVHAQSGYGSLSERPLYGLREELAPKYMPERLSSQHDQSSAPERNVTYGNKERGFDTSRPPSPLVRSGGATSTQNVAPDRIWPEERLLEMSMAAIKEFYSAKDEKEVALCVKDLNSPGFYPSMISLWVTDSFERKDMERDLLAKLIIGLTLSRDVAISQDQLIKGFENVLTSLEDAVNDAPRAAEFLGRIFGKVISENVIPFNEIGSLIYKGGEEEGRLVEIGLAAEVLGSTLEMIKVEQGDSAVSEICRSSTMRLENFRPQGSKKQWKLDKFI

SEQ ID NO: 731 - protein, 363 aa, Solanum lycopersicum
MNMSSTSTQFAPTRRMGIFEPFHHMSMWEDAFRGDIMPSVGACMITPANDRADDKSGYTSSDQLIPSGSEDNQAGKSISDKVQRRLAQNREAARKSRMRKKAYVQQLEKSNLKLAQLEMELERARQQGLYILGSNGNMGLSSTINPGIAAFEMEYSLWVEEQQKKNVELRNILQSHVSEMELQLLVETVLNHYYNLFRIKADAAKADVFYLMSGMWRTSVERFFLWIGGFKPSELINIVMPQLEPLSDQQIVKICNLRHCCQQAEDALTQGMDKLQQTLAQNILTMTTGMGSYSSQMVSSMEKLEALESFVNQADHLRQQTLQQMSLVLTTRQSARGLLAFGEYLQRLRALSSLWAARPREPT

SEQ ID NO: 732 - protein, 543 aa, Solanum lycopersicum
MANTTPNITNSVGIGIRIRTKIRPASTSMAATPAALSTGHCIPTGLLVINSGTSRRGGAARVDSVNGHLTRSRASSFSIRAAAEVEPVGTSSSAQGIENLVIIGSGPAGYTAAIYAARANLKPVVFEGFQAGGVPGGQLMTTTEVENFPGFPEGITGPDLMDRMRRQAERWGAELYQEDVEFIDVKNAPFTVHSSERKVKCHSIIVATGANARRLGLPREDEFWSRGISACAICDGASPLFKGQVLAVVGGGDTATEEAIYLTKYARHVHLLVRKDQLRASRAMQDRVFNNPNITVHFNTETVDVVSNPKGQMSGILIRKADTQEESVLEAKGLFYGIGHSPNSQLLEGQVELDNSGYILVKEGTANTSVEGVFAAGDVQDHEWRQAITAAGSGCVAALSVERYLTSKNLLLEFHQPPTEEVKKELSEKDVQEGFDITLTKHKGQYALRKLYHESPRLMCVLYTSPTCGPCRTLKPILSKVIDEFDKDVHLVEIDITEDPEIAEAAGIMGTPCVQFFKNKEMLRTVSGVKMKREYREFIEANK

SEQ ID NO: 733 - protein, 625 aa, Solanum lycopersicum
MTSNIHFFLLYVVSLFLFVQARLNLYPPDHAALLLVQKDLGIISVNNPCTLAGISCERRPGNTTQVVRVTRIVFRSNGLKGTLSSAIGKLTELKELSLSDNQLSEQIPVQIIDCRKLEILQLQRNRFSGKIPSELSALNRLRIVDFSSNEFSGNLDFLKYFPNLEKLSLADNMFTGKIPFSLKSFRNLRFLNISGNSFLEGPVPVMSQIEHLSADLNRKNGVPKRYILAENSTRISAMGPASVPAPAPAPVNRVVPAMHKRKNKKRKLRSWFLGFLAGTFAGGISAVLCSLLFKMVMFFVRRGNNDSSLTIYSPLIKKAEDLAFLEKEDGVASLEMIGKGGCGEVYRAELPGSNGKIIAIKKIIQSPMDAAEITEEDTKALNKKMRQVKSEIQIVGQIRHRNLLPLLAHMPRPDCHYLVYEYMKNGSLQDILQQVTEGTRELDWLGRHRIAAGVAAGLEYLHINHTQRIIHRDLKPANILLDDDMEARVADFGLAKAVPDAHTHITTSNVAGTVGFIAPEYYQTLKFTDKCDIYSFGVVLAVLVIGKGPSDDFFQHTSEMSLVKWLRNVMTSDDPKIAIDPKLIGNGYDEQMLLVLKIACFCTLDNPKERPNSKDVRCMLTQIKH

SEQ ID NO: 734 - protein, 270 aa, Solanum lycopersicum
MGRPPCCDKIGIKKGPWTPEEDIILVSYIQEHGPGNWRSVPTNTGLMRCSKSCRLRWTNYLRPGIKRGNFTPHEEGMIIHLQALLGNKWAAIASYLPQRTDNDIKNYWNTHLKKKLKKFQIELDSHNLTLPPPNLDNSNTNNYDHHHHQFTKLLNSPNSSSSSSLYASSTENISRLLEGWMRSSPNPSRRNNIDHDEMLHEAQKELQDQDGGVSNDDVVIIPNVNVDCESSEVVTHEKTSPPPFTYLEKWLLEENGGQVEELMELPMIFT

SEQ ID NO: 735 - protein, 574 aa, Solanum lycopersicum
MESAAVTVESVADKLKKQSLGNDGSNSKRMLKLEELNWDHSFVRELPADPRTDTIPREVLHACYTKMLPSVEVENPQLVVWSDSVAELLELDPKEFERPDFPLLFSGASPLVGAVPYAQNYGGHQFGMWAGQLGDGRAITLGEVLNSKSERWELQLKGAGKTPYSRFADGLAVLRSSIREFLCSEAMHSLGIPTTRALCLVMTGKDVSRDMFYDGNPKDEPGAIVCRVAESFLRFGSYQLHASRGKEDLEIVRTLADYTIRHHFPHLENMCKSESISFSIGEEDDTVVDLTSNKYAAWAVEVAEQTASTIARWQGVGFTHGVMNTDNMSVLGLTIDYGPFGFLDAFDPSFTPNTTDLPGRRYCFANQPDIGLWNVAQFATSLSTAQLLNDKEANYAIERYGIKFMDDYQAIMTKKLGLVKYNKQMIGELLKNMAVDKVDYTNFFRLLSNIKADPTIPDNQLLIPLKAALLDIGQERKEAWTSWVKSYIQELSTIGVSDDERKASMNSVNPKYILRNYLCQSAIDAAEQDDFGEVRRLLKVMQRPFDEQPGMEKYARLPPAWAYRPGVGMLSCSS

SEQ ID NO: 736 - protein, 201 aa, Solanum lycopersicum; identical to SEQ ID NO: 596

SEQ ID NO: 737 - protein, 83 aa, Solanum lycopersicum
MSSSRRAWIVAASVGAVEALKDQVGLCRWNYPLRSLAQHTKNNVRSYSQAKKLSSSITTKSEKMEKSEESLRKVMYLSCWGPN

SEQ ID NO: 738 - protein, 230 aa, Solanum lycopersicum
MAHAMASMGGLIGSSQTVLDGSLQLSGSARLSTVSTNRIALSRPGLTVRAQQGSVDIETSRRAMIGLVAAGLAGSVAKAAFAEARSIKVGPPPPPSGGLPGTLNSDEARDFSLPLKNRFYLQPLTPAEAAQRVKDSAKEIVSVKDFIDKKAWPYVQNDLRLRAEYLRYDLKTVISAMPKEQKGKLQDLSGKLFKTISDLDHAAKTKNSAEAQKYYAETVTTLNDVLANLG

SEQ ID NO: 739 - protein, 354 aa, Solanum lycopersicum
MSCFSCCDDDDMHRATDNGPFMAHNSAGNNGGQRATESAQRETQTVNIQPIAVPSIAVDELKDITDNFGSKALIGEGSYGRVYHGVLKSGRAAAIKKLDSSKQPDREFLAQVSMVSRLKDENVVELLGYCVDGGFRVLAYEYAPNGSLHDILHGRKGVKGAQPGPVLSWAQRVKIAVGAAKGLEYLHEKAQPHIIHRDIKSSNILLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVKQCVDARLNTDYPPKAIAKMAAVAALCVQYEADFRPNMSIVVKALQPLLPRPVPS

SEQ ID NO: 740 - protein, 370 aa, Solanum lycopersicum
MNCLQNLPRSSGLPLRSFTGNSRKLYSTVVSLGMTKFADQRLSIVAQVVSGPESTTEKDEEKSDTYSHDMTAAMGAVLTYRHELGMNYNFIRPDLIVGSCLQTPEDVDKLRSIGVKTIFCLQQNPDLEYFGVDINAIREYANKCGAIEHLRAEIRDFDAFDLRLRLPAVISILNKAINRNGGVTYIHCTAGLGRAPAVALTYMFWVQGYKLSEAFDLLMSKRSCFPKLDAIKSATADILTGLKKMPVTLTWHGDNCTTVEISGLDIGWGQRIPLKFDEERGLWTLQKDLHEGKYEYKYIVDGEWICNEFEPITSPNKDGHVNNYVEVLDENPDNITSAAVRKRLTGDDPDLTSDERLIIERFLEAHADVE

SEQ ID NO: 741 - protein, 989 aa, Solanum lycopersicum; identical to SEQ ID NO: 601

SEQ ID NO: 742 - protein, 345 aa, Solanum lycopersicum
MAMKVDLMNILITLFFVISMFNTQTRGRSQPKLSVSERHELWMSRHGRVYKDEVEKGERFMIFKENMKFIESVNKAGNLSYKLGMNEFADITSQEFLAKFTGLNIPNSYLSPSPMSSTEFKKINDLSDDYMPSNLDWRESGAVTQVKHQGRCGCCWAFSAVGSLEGAYKIATGNLMEFSEQELLDCTTNNYGCNGGFMTNAFDFIIENGGISRESDYEYLGQQYTCRSQEKTAAVQISSYQVVPEGETSLLQAVTKQPVSIGIAASQDLQFYAGGTYDGNCADRINHAVTAIGYGTDEEGQKYWLLKNSWGTSWGENGYMKIIRDSGDPSGLCDIAKMSSYPNIA

SEQ ID NO: 743 - protein, 629 aa, Solanum lycopersicum
MVKVMEKDTVVVSLVVWLILVVYHLKLIYANMEGDALHSLRVNLQDPNNVLQSWDPTLVNPCTWFHVTCNNDNSVIRVDLGNAALSGLLVPQLGLLKNLQYLELYSNNISGLIPSDLGNLTNLVSLDLYLNNFVGPIPDSLGKLSKLRFLRLNNNSLTGNIPMSLTNISSLQVLDLSNNRLSGAVPDNGSFSLFTPISFANNLDLCGPVTGRPCPGSPPFSPPPPFVPPPPISAPGGNGATGAIAGGVAAGAALLFAAPAIAFAWWRRRKPQEYLFDVPAEEDPEVHLGQLKRFSLRELQVATDSFSNKNILGRGGFGKVYKGRLADGSLVAVKRLKEERTPGGELQFQTEVEMISMAVHRNLLRLRGFCMTPTERLLVYPYMANGSVASCLRERPPSEPPLDWPTRKRIALGSARGLSYLHDHCDPKIIHRDVKAANILLDEEFEAVVGDFGLAKLMDYKDTHVTTAVRGTIGHIAPEYLSTGKSSEKTDVFGYGIMLLELITGQRAFDLARLANDDDVMLLDWVKGLLKEKKLEMLVDPDLQNKYVEAEVEQLIQVALLCTQSNPMDRPKMSEVVRMLEGDGLAERWDEWQKVEVLRQEVELAPHPGSDWLVDSTENLHAVELSGPR

SEQ ID NO: 744 - protein, 590 aa, Solanum lycopersicum
MKMFELSDSDSFAVFASSKNVFPPGFRFHPTDEELVLYYLKKKICGKRILLDAIAETDVYKWEPEDLPDLSKLKTGDRQWFFFSPRDRKYPNGARANRGTKRGHWKVTGKDRIIMCNSRAVGLKKTLVFYKGRAPVGERTDWVMHEYTMDEEELKKCQNAQDYYALYKVFKKSGSGPKNGEQYGAPFREEEWADDECPSAKGFVHQDNSTNHVIEAPSVDGGLEELLNPVLMEPLSVDYDYAVEQLVQEEDTRSTLLYHSAKEVNFPHRSAVIAPAKESFDLTQSGTSQRQLHEALEVTSAPVIYEQQPHVVEEDFLEMDDLLGPEPSTQNFDNLGPCVQNFDEAGQSGQNFDMPAGNFEDLPFDYFDGLAEFDLYHDASLLDDVRTTEVGQNTEPHMNNLVNGSVNPASTTYINTFQHEMMNNQPMYLNNSEQISNQLWVHDQRFNISYPSEANQLVAPPATSGVVYDSILANHPMDANQNQLPNQDEGTPSWLTSQLWAFVDSIPTAPAIAAESPVVNSAFKRMSSFSKMRINARNMNVAAAGNTATSRSSRYSKNGLFYFSFVGILCAILCVLLGTFVDILRRPISS

SEQ ID NO: 745 - protein, 381 aa, Solanum lycopersicum
MAALSASAHVRIRTFFHSSFTNNKISNFSQQFKLENYTTITTITTSKRSISIPALAPKTTENSASQLQSTSDSVKDSENINLKGWAEFAKNVSGEWDGFGADFSKQGEPIELPESVVPGAYREWEVKVFDWQTQCPTLARDDDAFSFMYKFIRLLPTVGCEADAATRYSIDERNISDANVAAFAYQSTGCYVAAWSNNHDGNYNTAPYLSWELEHCLIDPGDKESRVRIVQVVRLQDSKLVLQNIKVFCEHWYGPFRNGDQLGGCAIQDSAFASTKALDPAEVIGVWEGKHAISSYNNAPEKVIQELVDGSTRKTVRDELDLVVLPRQLWCCLKGIAGGETCCEVGWLFDQGRAITSKCIFSDNGKLKEIAIACESAAPAQ

SEQ ID NO: 746 - protein, 535 aa, Solanum lycopersicum; identical to SEQ ID NO: 607

SEQ ID NO: 747 - protein, 104 aa, Solanum lycopersicum
MAISKALFASLLLSLLLLEQVQSIQTDQVSSNAISEGADSYKKIDCGGACAARCRLSSRPRLCHRACGTCCARCNCVPPGTSGNTETCPCYASLTTHGNKRKCP

SEQ ID NO: 748 - protein, 446 aa, Solanum lycopersicum
MKKVKRKLGKYEVGRTIGEGTFAKVKFARNTETGENVAIKVLAKSTILKHRMVEQIKREISIMKIVRHPCIVRLHEVLASQTKIYIVQEFVTGGELFDKIVHLGRLSEDEARRYFQELIDAIAHCHSKGVYHRDLKPENLLLDFQGNLKISDFGLSALPQQGVELLYTTCGTPNYVAPEVLGNRGYDGAAADVWSCGIILYVLMAGYLPFDETDLPTLYTKIKAAEFSCPFWFSPGATSLIQKIIDPNPQTRIKIDGIKRDPWFRKNYRAVKAKADEVVNLDDIHAVFDDIEDAFVSEKSEDSESGPLVMNAFEMITLSQGLNLSALFDRRQDYVKRQTRFISRQPAKVVIETIEAAAESLGLKVHTRDYKTRIEGVTANRAGQFAVVLEVFQVAPSLFMVDVRKAAGDTLEYHKFYKTFCTKIDDVIWKPKEGMSNAVLLRTRTR

SEQ ID NO: 749 - protein, 164 aa, Solanum lycopersicum
MLPEMGSEGSSRVVVPRNFRLLEELERGEKGIGDGTVSYGMDDADDVYMQSWTGTIIGPPNTVHEGRIYQLKLFCGKEYPDQPPGVRFQSRINMSCVNYETGVVEPSHFPMLADWKRENTMEDILMQLKKEMTSPQNRKLAQPSDGNEEGRVDQKGLVVKCCIM

SEQ ID NO: 750 - protein, 341 aa, Solanum lycopersicum
MNSSSGNNFETKQESNNDSRLASKTTSAPPSSTSRQWGANKNPRIVRVSRTFGGKDRHSKVCTIRGLRDRRIRLSVPTAIQLYDLQDRLGLSQPSKVVDWLLEATKLDIDTLPPLPVPPEYFTRFQQPSHEEFSDVRAQWLNANTSYLEHGRNKSIASNEESNQEDNMFTLGNQRSSNLPGMPFNSYNYQWDHQPNSNLSLGHFGHNHSFSSQIDDDQSHQNTSFPLSLGSSSSPFPSSSQLYFNPITTTFQPIVPSPNYITNHHPIESHDPRANMNHFNFLSSTTSHNNQLVMPTLNLISSQMKPFSLNNDPRWMSSRDDEDDDDDDDDDDNQPHEGRAI

SEQ ID NO: 751 - protein, 249 aa, Solanum lycopersicum
MALPENLTREQCLYLAKLAEQAERYEEMVKFMDKLVIGSGSSELTVEERNLLSVAYKNVIGSLRAAWRIVSSIEQKEEGRKNDEHVVLVKDYRSKVESELSDVCAGILKILDQYLIPSASAGESKVFYLKMKGDYYRYLAEFKVGNERKEAAEDTMLAYKAAQDIAVAELAPTHPIRLGLALNFSVFYYEILNASEKACSMAKQAFEEAIAELDTLGEESYKDSTLIMQLLRDNLTLWTSDMQEQMDEA

SEQ ID NO: 752 - protein, 255 aa, Solanum lycopersicum
MASPREENVYMAKLAEQAERYEEMVEFMEKVVAALNGEELTVEERNLLSVAYKNVIGARRASWRIISSIEQKEESRGNEDHVASIKKYRSQIENELTSICNGILKLLDSKLIGSAATGDSKVFYLKMKGDYYRYLAEFKTGTERKEAAENTLSAYKSAQDIANGELAPTHPIRLGLALNFSVFYYEILNSPDRACNLAKQAFDEAIAELDTLGEESYKDSTLIMQLLRDNLTLWTSDMQDDGTDEIKEPSKADNE

SEQ ID NO: 753 - protein, 258 aa, Solanum lycopersicum
MASPREENVYMAKLAEQAERYEEMVEFMEKVVAAADGAEELTVEERNLLSVAYKNVIGARRASWRIISSIEQKEESRGNEDHVASIKEYRSKIESELTSICNGILKLLDSKLIGSAATGDSKVFYLKMKGDYHRYLAEFKTGAERKEAAENTLSAYKAAQDIANAELAPTHPIRLGLALNFSVFYYEILNSPDRACNLAKQAFDEAIAELDTLGEESYKDSTLIMQLLRDNLTLWTSDMQDDGTDEIKEATPKPDDNE

SEQ ID NO: 754 - protein, 252 aa, Solanum lycopersicum
MEKEREKQVYLARLAEQAERYDEMVEAMKAIAKMDVELTVEERNLVSVGYKNVIGARRASWRILSSIEQKEESKGHEQNVKRIKTYRQRVEDELTKICSDILSVIDEHLVPSSTTGESTVFYYKMKGDYYRYLAEFKAGDDRKEASEQSLKAYEAATATASSDLAPTHPIRLGLALNFSVFYYEILNSPERACHLAKQAFDEAIAELDSLSEESYKDSTLIMQLLRDNLTLWTSDLEEGGEHSKGDERQGEN

SEQ ID NO: 755 - protein, 250 aa, Solanum lycopersicum
MVKIAFGSIGDSLSVGSLKAYLAEFIATLLFVFAGVGSAIAFNKLTSGAALDPAGLVAIAVAHAFALFVGVSMAANISGGHLNPAVTLGLAVGGNITILTGLFYWVAQLLGSTVACLLLKYVTNGLAVPTHGVAAGMSGAEGVVMEIVITFALVYTVYATAADPKKGSLGTIAPIAIGFIVGANILAAGPFSGGSMNPARSFGPAVVAGDFSQNWIYWVGPLIGGGLAGFIYGDVFIGCHTPLPTSEDYA

SEQ ID NO: 756 - protein, 401 aa, Solanum lycopersicum
MGICLSARIKAESPFHTGLNSRSVSIDGGDSNSSSRVPSTTRSEGEILQSPNLKSFSFSDLRTATRNFRPDSVLGEGGFGSVFKGWIDENTFAATKPGTGVIIAVKRLNQEGFQGHREWLAEVNYLGQFSHPHLVKLIGYCLEDEHRLLVYEFMPRGSLENHLFRRGSYFQPLSWKLRLKVALGAAKGLAFLHSAETKVIYRDFKTSNILLDSNYTAKLSDFGLAKDGPTGDKSHVSTRVMGTYGYAAPEYMATGHLTSKSDVYSFGVVLLEMLSGRRAIDKNRPSGEHNLVEWAKPYLGNKRKVFRVLDTRLEGQYSMEVASKVANLALRCLSKDPRFRPSMSDIVKELEQLYQQSKDSGNTRSHASNRPRPRRRSAGDVANRNPSVAYPRPSASPLYAK

SEQ ID NO: 757 - protein, 1053 aa, Solanum lycopersicum
MKMMATLYFLWLLLIPSFQILSGYHIFLVSSQCLDDQKSLLLQFKGSLQYDSTLSKKLAKWNDMTSECCNWNGVTCNLFGHVIALELDDETISSGIENSSALFSLQYLESLNLADNMFNVGIPVGIANLTNLKYLNLSNAGFVGQIPITLSRLTRLVTLDLSTILPFFDQPLKLENPNLSHFIENSTELRELYLDGVDLSSQRTEWCQSLSLHLPNLTVLSLRDCQISGPLDESLSKLHFLSFVQLDQNNLSSTVPEYFANFSNLTTLTLGSCNLQGTFPERIFQVSVLESLDLSINKLLRGSIPIFFRNGSLRRISLSYTNFSGSLPESISNHQNLSRLELSNCNFYGSIPSTMANLRNLGYLDFSFNNFTGSIPYFRLSKKLTYLDLSRNGLTGLLSRAHFEGLSELVHINLGNNLLSGSLPAYIFELPSLQQLFLYRNQFVGQVDEFRNASSSPLDTVDLTNNHLNGSIPKSMFEIERLKVLSLSSNFFRGTVPLDLIGRLSNLSRLELSYNNLTVDASSSNSTSFTFPQLNILKLASCRLQKFPDLKNQSWMMHLDLSDNQILGAIPNWIWGIGGGGLTHLNLSFNQLEYVEQPYTASSNLVVLDLHSNRLKGDLLIPPCTAIYVDYSSNNLNNSIPTDIGKSLGFASFFSVANNGITGIIPESICNCSYLQVLDFSNNALSGTIPPCLLEYSTKLGVLNLGNNKLNGVIPDSFSIGCALQTLDLSANNLQGRLPKSIVNCKLLEVLNVGNNRLVDHFPCMLRNSNSLRVLVLRSNKFYGNLMCDVTRNSWQNLQIIDIASNNFTGVLNAEFFSNWRGMMVADDYVETGRNHIQYEFLQLSKLYYQDTVTLTIKGMELELVKILRVFTSIDFSSNRFQGAIPDAIGNLSSLYVLNLSHNALEGPIPKSIGKLQMLESLDLSTNHLSGEIPSELASLTFLAALNLSFNKLFGKIPSTNQFQTFSADSFEGNSGLCGLPLNNSCQSNGSASESLPPPTPLPDSDDEWEFIFAAVGYIVGAANTISVVWFYKPVKKWFDKHMEKCLLWFSRK

SEQ ID NO: 758 - protein, 373 aa, Solanum lycopersicum; identical to SEQ ID NO: 609

SEQ ID NO: 759 - protein, 336 aa, Solanum lycopersicum
MEKVKSMEKKKLINELTQGKEFVNQLKNQIIGPLASPEECDLLIGKILSTLEKSLSILNLKALLLEGGINNINNSTSSCSSISFLGSSNNNISPKSEVFDSSREKLDKNMVSKKRKKTQQWINQTSISVNGLEGPCEDGFSWRKYGQKDILGASHPRAYYRCTHRNTQGCLATKQVQKSDANSTIFEVTYKGRHSCKVAQSEIFSLNNQKRQKCNKKQQEEMVIFNSATPNHNAENFNIITAKDEEVFTAFPFPPAPLHIENIIEENKFFPDSSELPLYLASPNDEFGMEHMILQSSDSDLTELISTPTSISNSSFGGEGVDYEPEITFDIEEFFI

SEQ ID NO: 760 - protein, 524 aa, Solanum lycopersicum
METVFRKSTHGGVVKQDIKIKASEEGFVEDINDLKVEKERKSIHNEDDNSKSSQQKDLTGDKKDDQLESAKADMEEVMEENQRLKKHLDKIMKDYRNLQMQFHEVAQRDAEKTNTDVKHDEAELVSLSLGRTSSDTKKELSKLILSKKENDEKEEDNLTLALDCKFQSSTKSSPSNLSPENSLGEVKDDEKGTDQTWPPHKVLKTMRNEEDDVTQQNPTKRAKVSVRVRCDTPTMNDGCQWRKYGQKIAKGNPCPRAYYRCTVAPNCPVRKQVQRCIQDMSILITTYEGTHNHPLPHSATSMAFTTSAAASMLLSGSSSSGSGPTSSTASATTSALNYCFSDNSKPNPFYNLPHSSISSSSHSQYPTITLDLTSNSSTSSFPGQNYRTIANSNNYPPRYNNNNSSTNILNFSSFESNHLLPMSWSNRNNQDTHSQSYLQNNIKSAASTQTLLPQDTIAAATKAITSDPKFQSALAVALTSIIGSRSGNHHIDEKSGQNMKVTEPFPVLCSFPSTSPGDHKDYTL

SEQ ID NO: 761 - protein, 412 aa, Solanum lycopersicum; identical to SEQ ID NO: 646

SEQ ID NO: 762 - protein, 652 aa, Solanum lycopersicum
MGSLGGEVSVSLLQKKKPMWSYPKVMGVHPSERWGHSSCNSNGFVYVFGGCRGGLHFSDVLVLNLEAMAWSILVTTGQGPGPRDSHSAVLIGHRMVVFGGTNGSRKVNDIHVLDVRSQEWTQLECQGNPPSPRESHTATIVGGDKLVIFGGSGEGEANYLNDLHVLDLKTMRWSSPEVRGEMPVPRDSHSAVAIGNRLFIYGGDCGDRYQGDVDVLDMDTLMWSKLDVLGPSPDARAGHASVNFGSKVYVIGGVGDKKYYNDVWVLDVINSSWTQLDVTGQKPQGRFSHTAASRNTDIVIYGGCGEDERPLNELLILQFGVEYPNGTSSLSGGRVSGNTSHYDKKRFLKERDNSSEAICRGKKEDIQTTGSQELEFVSKAAFRFSSDTLHPKRRRMSHNSHIFNLESDQEEDQSPSLSQCCSPPSQSDVEMSTIKQVSGSGTASDRFPFARQQHLIPNNCQPNPRNVIARNPHDLQLFREQSNPSNSSGHVPPAVLMDKQEVQCQSLEPGRFHNLIGAEIRGKVDGAFDSGYLMTAIVNGKIFRGVLFAPAPDLVPRGPVLGHNPSPSPGHIGVNYANHISLGCRRQPQQQQLVQLQVPELGRHSIGKVPIRRSTSSVMRSSHQLDKDTQKRSELEGVVLTLGGPGCGNAKT

SEQ ID NO: 763 - protein, 1123 aa, Solanum lycopersicum; identical to SEQ ID NO: 675

SEQ ID NO: 764 - protein, 1131 aa, Solanum lycopersicum
MASGSRTKHSYHNSSQGQAQSSGTSNMNYKDSISKAIAQYTADARLHAVFEQSGESGKSFDYSQSVKTTTQSVPERQITAYLTKIQRGGHIQPFGCMIAVDEASFRIIAYSENACEMLSLTPQSVPSLDKSEILTVGTDVRTLFTPSSSVLLERAFGAREITLLNPIWIHSKNSGKPFYAILHRVDVGIVIDLEPARTEDPALSIAGAVQSQKLAVRAISHLQSLPGGDIKLLCDTVVESVRELTGYDRVMVYKFHEDEHGEVVAESKRSDLEPYIGLHYPATDIPQASRFLFKQNRVRMIVDCHATPVRVTQDESLMQPLCLVGSTLRAPHGCHAQYMANMGSIASLTLAVIINGNDEEAVGGGRNSMRLWGLVVGHHTSVRSIPFPLRYACEFLMQAFGLQLNMELQLASQLSEKHVLRTQTLLCDMLLRDSPPGIVTQSPSIMDLVKCDGAALYYQRKYYPLGVTPTEAQIKDIVEWLLAYHGDSTGLSTDSLADAGYPGAASLGDAVCGMAVAYITSKDFLFWFRSHTAKEIKWGGAKHHPEDKDDGQRMHPRSSFKAFLEVVKSRSSPWENAEMDAIHSLQLILRDSFKDAEASNSKAIVHALGEMELQGIDELSSVAREMVRLIETATAPIFGVDVNGRINGWNEKVVELTGLSAEEAKGKSLVHDLLYKESQESAEKLLYNALRGVEGKNVEIKLRTFGAEQVEKAVFLVVNACSSRDYTNSIVGVSFVGQDVTGEKIVMDKFIHIQGDYKAIVHSPNPLIPPIFASDENTSCSEWNTAMEKLSGWSREEIVGKMLVGEIFGSCCRLKGPDAMTKFMIVLHNAIGGQDTDKFPFSFFDRNGKYVQALLTANKRVNMEGDTIGAFCFIQIASPELQQALRVQRQQEKKCYSQMKELAYICQEVKSPLNGIRFTNSLLEATNLTEYQKQYLETSAACERQMSKIIRDVDLENIEDGSLTLEKEDFFLGSVIDAVVSQVMLLLREKGVQLIRDIPEEIKTLTVHGDQVRIQQVLADFLLNMVRYAPSPDGWVEIQLRPSMMPISDGATVVHIELRIICPGEGLPPELVQDMFHSSRWVTQEGLGLSMCRKMLKLMNGEIQYIRESERCYFMIILDLPMTRKGPKSVG

SEQ ID NO: 765 - protein, 358 aa, Solanum lycopersicum; identical to SEQ ID NO: 692

SEQ ID NO: 766 - protein, 177 aa, Solanum lycopersicum; identical to SEQ ID NO: 695

SEQ ID NO: 767 - protein, 769 aa, Solanum lycopersicum; identical to SEQ ID NO: 698

SEQ ID NO: 768 - protein, 163 aa, Solanum lycopersicum; identical to SEQ ID NO: 703

SEQ ID NO: 769 - protein, 175 aa, Solanum lycopersicum; identical to SEQ ID NO: 704

SEQ ID NO: 770 - protein, 181 aa, Solanum lycopersicum; identical to SEQ ID NO: 705

SEQ ID NO: 771 - protein, 175 aa, Solanum lycopersicum; identical to SEQ ID NO: 706

SEQ ID NO: 772 - protein, 274 aa, Solanum lycopersicum
MNSTSMSSLGVRKGSWTDEEDFLLRKCIDKYGEGKWHLVPIRAGLNRCRKSCRLRWLNYLRPHIKRGDFEQDEVDLILRLHKLLGNRWSLIAGRLPGRTANDVKNYWNTNLLRKLNTTKIVPREKINNKCGEISTKIEIIKPQRRKYFSSTMKNVTNNNVILDEEEHCKEIISEKQTPDASMDNVDPWWINLLENCNDDIEEDEEVVINYEKTLTSLLHEEISPPLNIGEGNSMQQGQISHENWGEFSLNLPPMQQGVQNDDFSAEIDLWNLLD

SEQ ID NO: 773 - protein, 361 aa, Solanum lycopersicum
MKALILVGGFGTRLRPLTLSVPKPLVEFANKPMILHQIEALKAVGVTEVVLAINYQPEVMLNFLKEFEASLGIKITCSQETEPLGTAGPLALARDKLIDDSGEPFFVLNSDVISEYPFKEMIQFHKSHGGEASLMVTKVDEPSKYGVVVMEESTGQVERFVEKPKLFVGNKINAGFYLLNPSVLDRIQLRPTSIEKEVFPKIAAEKKLYAMVLPGFWMDVGQPRDYITGLRLYLDSLKKHSSPKLASGPHIVGNVIVDESAKIGEGCLIGPDVAIGSGCVIESGVRLSRCTVMRGVRIKKHACISGSIIGWHSTVGQWARVENMTILGEDVHVCDEIYSNGGVVLPHKEIKSSILKPEIVM

SEQ ID NO: 774 - protein, 609 aa, Solanum lycopersicum
MVRKLNSFRKSFEDKRLRERLLSLCNGVEYTELPGFRHSLDHQDQETSGCCSSFRERFSELWKDWKRVSVKAMEMGRTDPRKIIFSAKMGLALILISLLIFFKEPAVKELGKYSVWAILTVVVVFEFSIGATLSKGFNRGLGTLSAGGLALAMAELSQLAGEWEEVVIVIGIFITGFLITYAKQYPAMKPYEYGFRVFLITYCFIMVSGYHTREFIETAVSRFLLIALGASISLAVNICVYPIWAGEDLHNLVTKNFINIANSLEGCISEYLNCVEYKRIPSKILTYQVADDPVYNGYRSAVESISQEEALEAFAVWEPPHGPYKMIKYPWKNYVKVSGALRYCAFMVMALHGCILSEIQAPAERRQVFRNELQRVGTASAKVLRELGEKVKKMEKLGSGDILYEVHEAAEELQKKVDRKSYLFVNAENWEIGTRATAVDISQELGSMDEDKSLLQHHRSQSETVINIDSILASKSWDNRTCNLASNNNQTTGVTPENSVGKPKFRTTHSLPKDNDALKEVEAGEDEEEEEEESKTYESASALSLATFTSLLIEFVARLQNVVDSFEELSEKAKFKDPMDLSDASQKVGLWSRFKGCIKFWKRESSLPV

SEQ ID NO: 775 - protein, 159 aa, Solanum lycopersicum; identical to SEQ ID NO: 707

SEQ ID NO: 776 - protein, 342 aa, Solanum lycopersicum
MADECAAFMKGTELPVKRPREEEAETEMEAANNSNNGCEKEESSPYISSVLPGWFSEISPLWPGEAHSLKVEKILFQGKSDYQNVLVFQSSTYGKVLVLDGVIQLTERDECAYQEMITHLPLCSIPNPKKVLVIGGGDGGVLREVSRHSSVEQIDICEIDKMVVEVAKQFFPDVAVGYEDPRVNLHIGDGVAFLKNVPAGTYDAVIVDSSDPIGPAQELFEKPFFESIAKALRPGGVVSTQAESIWLHMHIIEEIVANCRQIFKGSVNYAWTTVPTYPSGMIGFMLCSTEGPAVDFKNPINPIDDESPAKSIEPLKFYNSEIHQASFCLPSFAKRVIETKGK

SEQ ID NO: 777 - protein, 582 aa, Solanum lycopersicum
MEILRKSSSLWALPILVLCFFINNGVFVDASHKVYMHLQSTTSHVDASKVHRTGYHFQPPKNWINDPNGPMYYNGVYHLFYQYNPKGATWGNIVWAHSVSKDLINWIPLEPAIYPSKVFDKYGTWSGSATILPGNKPVILYTGIVDANKTQVQNYAIPANMSDPYLRKWIKPDNNPLIVADKNINKIQFRDPTTAWMGRDGYWRVLVGSVRNHRGKVIMYKSNKNFMKWTKAKHPLHSAQGTGNWECPDFFPVSLKNENGLDTSYDGKDVKHVLKVSFDVTRFDHYTVGTYDTKKDKYFPDNTSIDGWKGLRLDYGNYYASKTFFDSGKNRRILLGWANESDTVDNDVKKGWAGVHPIPRKIWLDPSGKQLVQWPVQELETLRKKKVQLNNKKLNKGEKVEIKGITVAQADVEVIFSFASLDKAEPFDSSWADLYAQDVCAIKGSTVQGGLGPFGLLTLASKNLEEYTPVFFRVFKAHDNYKVLMCSDASRSSLKNETTMYKPSFAGYVDVDLADKKLSLRSLIDNSIVESFGAGGKTCITSRVYPTLAIFDKAHLFAFNNGAETITIETLNAWSMANAKLH

SEQ ID NO: 778 - protein, 464 aa, Solanum lycopersicum; identical to SEQ ID NO: 637

SEQ ID NO: 779 - protein, 1090 aa, Solanum lycopersicum; identical to SEQ ID NO: 639

SEQ ID NO: 780 - protein, 268 aa, Solanum lycopersicum; identical to SEQ ID NO: 642

SEQ ID NO: 781 - protein, 224 aa, Solanum lycopersicum; identical to SEQ ID NO: 567

SEQ ID NO: 782 - protein, 338 aa, Solanum lycopersicum
MANGKIKIGINGFGRIGRLVARVALQRDDVELVAVNDPFISTDYMTYMFKYDSVHGQWKHHELKVKDEKTLLFGEKAVTVFGIRNPEDIPWGEAGADFVVESTGVFTDKDKAAAHLKGGAKKVVISAPSKDAPMFVVGVNENEYKPELDIVSNASCTTNCLAPLAKVINDRFGIVEGLMTTVHAMTATQKTVDGPSMKDWRGGRAASFNIIPSSTGAAKAVGKVLPQLNGKLTGMAFRVPTADVSVVDLTVRLEKEASYEDIKAAIKEESEGKLKGILGYTEDDVVSTDFVGDSRSSIFDAKAGIALSKNFVKVVSWYDNEWGYSSRVIDLICHMAKA

SEQ ID NO: 783 - protein, 337 aa, Solanum lycopersicum
MAKVKIGINGFGRIGRLVARVALQRNDVELVAVNDPFISVDYMTYMFKYDSVHGQWKHHELKVKDEKTLLFGEKAVTVFGFRNPEEIPWAQTGADYIVESTGVFTDKDKAAAHLKGGAKKVIISAPSKDAPMFVVGVNEKEYKPELNIVSNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEATYDEIKAAIKEESEGKLKGILGYTEDDVVSTDFVGDNRSSIFDAKAGIALSKNFVKLVAWYDNEWGYSTRVVDLIIHMSSVQ

SEQ ID NO: 784 - protein, 363 aa, Solanum lycopersicum; identical to SEQ ID NO: 654

SEQ ID NO: 785 - protein, 605 aa, Solanum lycopersicum; identical to SEQ ID NO: 579

SEQ ID NO: 786 - protein, 270 aa, Solanum lycopersicum; identical to SEQ ID NO: 734

SEQ ID NO: 787 - protein, 386 aa, Solanum lycopersicum; identical to SEQ ID NO: 595

SEQ ID NO: 788 - protein, 346 aa, Solanum lycopersicum
MRTSMLKSIVRRSSTAGASYVSRRGFASGSAPERKVAVLGAAGGIGQPLSLLMKLNPLVSSLSLYDIAGTPGVAADVSHINTRSEVAGFAGEEQLGQALEGADVVIIPAGVPRKPGMTRDDLFNINAGIVKSLCTAIAKYCPNALVNMISNPVNSTVPIAAEVFKKAGTYDEKKLFGVTMLDVVRAKTFYAGKAKVNVAEVNLPVVGGHAGITILPLFSQATPKANLSDEEIVALTKRTQDGGTEVVEAKAGKGSATLSMAYAGAIFADACLKGLNGVPDVVECAFVQSNVTELPFFASKVRLGKNGVEEVLGLGPLNDYEKQGLEALKPELLSSIEKGIKFAKEN

SEQ ID NO: 789 - protein, 265 aa, Solanum lycopersicum
MGRAPCCEKMGLKKGPWTPQEDNILISYIQNNGHSNWRALPKLAGLLRCGKSCRLRWTNYLRPDIKRGNFTKEEEDTIIKLHENLGNRWSAIAARLPGRTDNEIKNIWHTNLKKKLKNYQPCQNSKRHSKTSHVSNKGPTTSESSNNSDLSTSTKQHIKIAPNSPQLSSSEMSSVTLVVDDNQMVIIKEEKIESSSSEYFPKIDESFWADELSTENNMIIGHDQEIQVREENVDIFTTSSKMEEDMDFWYNVFIKTGDLPELPEF

SEQ ID NO: 790 - protein, 717 aa, Solanum lycopersicum
METVDSTRAFVKNVKRLIVKVGTAVVTRADGRLALGRLGALCEQLQELNSQGYEVILVTSGAVGVGRQRLRYRKLLNSSFLDLQKPQTELDGKACAAVGQNGLMALYDSLFSQLDVTSAQLLVTDNDFRDPDFRRQLNDTVNSLLSLKVIPIFNENDAISTRRAPYEDSSGIFWDNDSLAALLALELKADLLVLLSDVDGLYSGPPRDPDSKLIYTYIKEIHERVITFGDKSRVGRGGMTAKVKAAMYAAYAGIPVVITSGFATDNIIKVLHGERIGTLFHCDANKWASIGETDAREMAVAARACSRRLQALSSQERSKILQDIADALEANEKAILAENEADVVAAQQAGYEKSLISRLALNPGKISSLANSVRVLSNMDEPLGHTLKRTEIADGFILEKSSSPLGVVLIIFESRPDALVQIASLAVRSGNGLMLKGGKEAKRSNAILHKVITSAIPVSVGERLIGLVTSREEIPELLKLDDVIDLVIPRGSNKLVSQIKASTKIPVLGHADGICHVYVDKSADMDMAKRITVDAKIDYPAACNAMETLLVHKDLAQNGGLNDLIVELQTKGVSLYGGPKASSLLMIPEARTFRHEYSSLACTVEVVEDVYAAIDHIHQHGSAHTDSIITEDQEVAEVFLRQVDSAAVFHNASTRFSDGFRFGLGAEVGISTGRIHARGPVGVEGLLTTKWLARGSGQIVDGDKSIVYSHKDLTQQG

SEQ ID NO: 791 - protein, 417 aa, Solanum lycopersicum; identical to SEQ ID NO: 701

SEQ ID NO: 792 - protein, 500 aa, Solanum lycopersicum
MPEIERHRTRHNRPAIREPVKPRVPLRLLLRVASVAGGIQFGWALQLSLLTPYVQELGIPHAWASIIWLCGPLSGLLVQPLVGHMSDKCTSRFGRRRPFIVAGAASIMIAVLIIGFSADIGWLLGDRGEIKVRAIAAFVVGFWLLDVANNMTQGPCRALLADLTQKDHRRTRVANAYFSLFMAIGNILGFATGSYSGWYKIFPFTLNTACTINCANLKAAFILDIIFIATTTCISISAANEQPLDPSRGSSHTGEEIDESSHGQEEAFLWELFGIFKYFPGVVWVILLVTALTWIGWFPFLLFDTDWFGREIYGGEPNDGKNYSAGVRMGSLGLMLNSVLLGLTSLFMEKLCRKWGAGFTWGVSNVVMSLCFIAMLIITAVRSNIDIGQGLPPDGIVIAALVVFSILGIPLAITYSVPYALVSSRIEALGLGQGLSMGVLNLAIVFPQIVVSLGSGPWDELFGGGNSPAFVVAALSAFAGGLIAILAIPRTRVERPKIFA

SEQ ID NO: 793 - protein, 172 aa, Solanum lycopersicum
MEAETSAASDTPVTRKKMIMVAIDESEESFYSLKWALDNLINDPSIIITLINVQIPFTPMVYPAGPVVFATPTVVEAVRKGQQENATRILSRALHLCQQKMVKAETLIVEGDPKDMICQTAHELHVDLLVIGSRGLGKIKRAFLGSVSDYCAHHVQCPILIVKPPKENPKSS

SEQ ID NO: 794 - protein, 363 aa, Solanum lycopersicum
MESPRVEESYDKMSELKAFDDTKAGVKGLVDSGITKVPQIFVLPPKDRAKKCETHFVFPVIDLQGIDEDPIKHKEIVDKVRDASEKWGFFQVVNHGIPTSVLDRTLQGTRQFFEQDNEVKKQYYTRDTAKKVVYTSNLDLYKSSVPAASWRDTIFCYMAPNPPSLQEFPTPCGESLIDFSKDVKKLGFTLLELLSEGLGLDRSYLKDYMDCFHLFCSCNYYPPCPQPELTMGTIQHTDIGFVTILLQDDMGGLQVLHQNHWVDVPPTPGSLVVNIGDFLQLLSNDKYLSVEHRAISNNVGSRMSITCFFGESPYQSSKLYGPITELLSEDNPPKYRATTVKDHTSYLHNRGLDGTSALSRYKI

SEQ ID NO: 795 - protein, 485 aa, Solanum lycopersicum; identical to SEQ ID NO: 611

SEQ ID NO: 796 - protein, 380 aa, Solanum lycopersicum
MSTTVGQVIRCKAAVAWEAGKPLVMEEVDVAPPQKMEVRLKILYTSLCHTDVYFWEAKGQNPVFPRILGHEAAGIVESVGEGVTDLAPGDHVLPVFTGECKDCAHCKSEESNMCSLLRINTDRGVMLNDGKSRFSINGNPIYHFVGTSTFSEYTVVHVGCVAKINPLAPLDKVCVLSCGISTGLGASLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPLNFLNERTLKGTFFGNYKPRSDIPCVVEKYMNKELELEKFITHTLPFAEINKAFDLMLKGEGLRCIITMAD

SEQ ID NO: 797 - protein, 1000 aa, Solanum lycopersicum; identical to SEQ ID NO: 616

SEQ ID NO: 798 - protein, 578 aa, Solanum lycopersicum; identical to SEQ ID NO: 556

SEQ ID NO: 799 - protein, 136 aa, Solanum lycopersicum
METNKWEGKRSITEAEKEEDEHGSVEEDSKRKRVLTLSGRKLVGEGSAHPSCQVDQCTADMADAKPYHRRHKVCEFHSKSPIVLISGLQKRFCQQCSRFHLLAEFDDAKRSCRRRLAGHNERRRKITYDSHGENLG

SEQ ID NO: 800 - protein, 1207 aa, Solanum lycopersicum; identical to SEQ ID NO: 634

SEQ ID NO: 801 - protein, 464 aa, Solanum lycopersicum; identical to SEQ ID NO: 637

SEQ ID NO: 802 - protein, 467 aa, Solanum lycopersicum; identical to SEQ ID NO: 638

SEQ ID NO: 803 - protein, 523 aa, Solanum lycopersicum; identical to SEQ ID NO: 641

SEQ ID NO: 804 - protein, 268 aa, Solanum lycopersicum; identical to SEQ ID NO: 642

SEQ ID NO: 805 - protein, 568 aa, Solanum lycopersicum
MTDVQAPPPRPKRKKNIMDLLVQFRWIVVIFVVLPLSFLYYFSIYLGDVRSECKSYKQRQKEHDENVKKVVKRLKERNASKDGLVCTARKPWVAVGMRNVDYKRARHFEVDLSPFRNVLNIDTERMIAKVEPLVNMGQISRVTVPLNVSLAVVAELDDLTVGGLINGYGIEGSSHIYGLFSDTVVSYEVVLADGQVVRATKDNEYSDLFYAIPWSQGTLGLLVSAEIKLIPIKEYMKLTYKPVVGNLKEIAQAYMDSFSPRDGDQDNHEKVPDFVETMVYTPTEAVCMTGRYASKEEAKKKGNVINNVGWWFKTWFYQHAQTALKKGEFVEYIPTREYYHRHTRCLYWEGKLILPFGDQWWFRFLFGWAMPPKVSLLKATQGEYIRNYYHENHVIQDMLVPLYKVGDALEWVHREMEVYPLWLCPHRLYRLPLKTMVYPEPGFELQKRQGDTKYAQMYTDVGVYYAPGPILRGEVFDGIEAVRKLESWLIENHGFQPQYAVSELTEKNFWRMFDGSLYENCRKKYRAIGTFMSVYYKSKKGKKTEKEVQEAEQETAEVETPEVDEPED

SEQ ID NO: 806 - protein, 196 aa, Solanum lycopersicum
MEGNNSSSKSTTNPALDPDLDSPDQPGLEFAQFAAGCFWGVELAFQRVGGVVKTEVGYSQGNVHDPNYKLICSGTTEHAEAIRIQFDPNVCPYSNLLSLFWSRHDPTTLNRQGNDVGKQYRSGIYYYNDAQAQLARESLEAKQKEFMDKKIVTEILPAKRFYRAEEYHQQYLEKGGGRGCKQSAAKGCNDPIRCYG

SEQ ID NO: 807 - protein, 460 aa, Solanum lycopersicum
MAAKPIDDTIWRGSFMISRPEMRLNLTAHLSSKACAKVWLAAKEMAEVIYPEFLPKRDVWPKSFKSAKLIDDNIAIYFFSVKGRDDQVFENLLYNLRHYDIALRALVGDSELLIFTSAHLPEKHHIAGFEGKVYLWGVFSGRQAPPQESPDDCFIHNTRVTQASIPNSANDGKDRSCKEFSNRKDPSTASKSARKGRPLDDAWQHATPVDGKKQRTVCNYCGFISSSGGITYLKTHLGGGDPTGSLKGCPNVPPEVKRVMKEWLLGTIRGGKAPQLQEIRTDFEVPASKKSVRRGRPLDAAWDYATPVDAKRQRAVCKYCGFISSSGGITHLKAHLAGGDPKGPSKGCPNVPPEVKRAMAESLNRTVKGAKSMQPDEIRRYMKAENDWSPPRSDDYSLNQHRIVKNAQYSHFANGNSVNDMTLSKQSETAHVDSYMEVMSSHNACKSSFLSKPSTRVGFI

SEQ ID NO: 808 - protein, 224 aa, Solanum lycopersicum; identical to SEQ ID NO: 567

SEQ ID NO: 809 - protein, 754 aa, Solanum lycopersicum
MMKKVVSWLLFLSIVASLWVVDGYIECPCDDSDAFFSMETMLFVQKAGDLGIAVAYFSIPIEIIYFVSCSSFPFKWVLFQFGAFIVLCGLTHFLTFLTHFGKYTFHLILALIVCKLLTALVSMLTAITLMNLIPLLLKAKAREFMLRRKNRELDREVEKIKQLEELGLHVRMLTNEIRKSIDRHTILYTTLVGLSKLLSLQNCVIWMPNENRTEMKLTHDTTRENVSSVYNVPIPISDREVKEIKGSDDVKILGADSRLAAASSRGSCEPESVAAIRIPMLTVSNFRGETREIVSQCYAILVLVQPCGHGRFWLNQEVEIVRAAADQVAVALSHAAVVEESEYIKDRLMEQNQALQKAREEALRASQARSSFQTVMSHRLRRPMHSILGLLSMLQEQKLRDEQQLLVHSIIKSSNVVSTLMDDVIVTSTKENVKFPLEMKHFQLHSLIREAACTAKSLCMYKGYNITIEVEKSFPNKVMGDERRFFQVLLHIIGNLLNGIHGGHLTFKVLSASENDVSWKTPRSNSSNDIVYIKFEICTKFNRSQSEITPAPPTYDTEEIEESLSFAVCRKLVHLMQGDIFIIRNLADFDQGMAVIVGFQRQPLIPLGMSEYVESSNPTYPHPVLRGVEVLLADYDDSNRAVTKKMLEKLGCIVTLVSSGYECLGAVGPVVSSLQIILLDLHLPDLDGFEVTMRLRKHRRQTWPLIIGLAAITDEDIRKCLKIGMNGIICKPLLLSGLADELQKVLLHANRGMP

SEQ ID NO: 810 - protein, 261 aa, Solanum lycopersicum
MGIIIFILVLLFVDSCFNIVEGRIPGVYSGGSWETAHATFYGGSDASGTMGGACGYGNLYSQGYGVNTAALSTALFNNGLSCGACFELKCTNTPNWKWCLPGNPSILITATNFCPPNYALPNDNGGWCNPPRPHFDLAMPMFLKLAQYRAGIVPVTYRRIPCRKQGGIRFTINGFRYFNLVLITNVAGAGDIIKVWVKGTKTNWIPLSRNWGQNWQSNAVLTGQSLSFRVKASDHRSSTSWNMVPSHWQFGQTFIGKNFKI

SEQ ID NO: 811 - protein, 362 aa, Solanum lycopersicum
MAPSTLTALANEKTLETSFIRDEEERPKVAYNKFSDEIPVISLQGIDDVNGRRSEICERIVNACEDWGVFQVIDHGVDAQLISQMTKLAKEFFELPPEEKLRFDMSGGKKGGFIVSSHLQGEVVQDWREIVTYFSYPIRARDYSRWPDKPQGWIGVTEQYSEKLMDLACKLLEVLSEAMGLEKEALTKACVDMDQKVVVNFYPKCPEPDLTLGLKRHTDPGTITLLLQDQVGGLQATKDNGKTWITVQPVEGAFVVNLGDHGHYLSNGRFKNADHQAVVNSNSSRLSIATFQNPAPDAKVYPLKIREGEKSIMDEPITFAEMYRRKMSKDLELARLKKLAKEEKIQTEEAKLESKPIEEILA

SEQ ID NO: 812 - protein, 484 aa, Solanum lycopersicum
MVLSKTPSDDSVHSTFASRYVRTSLPRFEMLEKSIPKEAAYQMINDELMLDGNPRLNLASFVTTWMEPECDKLMMASINKNYVDMDEYPVTTELQNRCVNMIARLFNAPLKEEEIGIGVGTVGSSEAIMLAGLAFKRNWQNKRKAEGKPYDKPNIVTGANVQVCWEKFANYFEVELKQVKLSEGYYVMDPIKAVEMVDDNTICVAAILGSTLNGEFEDVKLLNDLLIEKNKQTGWDTPIHVDAASGGFIAPFIYPELEWDFRLPLVKSINVSGHKYGLVYAGIGWVIWRTKQDLPQQLIFHINYLGADQPTFTLNFSKGSSQVIAQYYQLIRLGYEGYRNVMENCRENAIVLRKGLEKTGRFNIISKDEGIPLVAFSLKDNSLHNEFEVSETLRRFGWIVPAYTMPADLQHVTVLRVVIREDFSRTLADRLVSDIVKVLHELPNAKKVEDNLMINNEKKTEIEVQRAIAEFWKKYVLARKASIC

SEQ ID NO: 813 - protein, 252 aa, Solanum lycopersicum
MESIYDSAGLDLGLGYSSTVNQTSRKDGQVAAVKSDLGFEPSLNLSLSSGDHQMVDLKTENKDQLSVASSYSNGSVKRERDIGSEVTEVERVISCRVSHDEDYYEDDDASNGKKKLRLTKVQSALLEESFKQQSTLNLKQKQNLARKLNVRPRQVEVWFQNRRARTKLKQTEVDCEFLKKYCETLTDENKKLYKELQELKALKVGQPLYMKLPAAATLTVCPSCERVGAGAAQNSAKPPHLYGSFTNPSAAC

SEQ ID NO: 814 - protein, 462 aa, Solanum lycopersicum
MAAQPKNVGILAVEIYFPPTCLQQEALEAHDGASKGKYTIGLGQDCMGFCTEVEDVISMSLTAVTSLLEKYAIDPKQIGRLEVGSETVIDKSKSIKTFLMQIFEKSGNTDIEGVDSTNACYGGTAALFNCVNWVESSSWDGRYGLVVCTDSAVYAEGAARPTGGAAAIAMLVGPDAPIVFESKIRASHMAHVYDFYKPILDSEYPVVDGKLSQTCYLMALDSCYKSLCNKYEKLEGKQFSIDDAAYFVFHSPYNKLVQKSTARLMFNDFTRNASSIDESTKEKLAPFSSLTGDESYQSRDLEKTSWQVAKPFYDEKVKPATLIPKQVGNMYTASLYAAFASLLHNKHSSLAGQRVVLFSYGSGLTATMFSLKLHEGQHPFNLSNIATVMNIEEKLKSRHEFTPENFIETMKIMEHRYGGKDFVTSKDCSLLAPGTYYLTEVDSKYRRFYAKKCAENGLANGH

SEQ ID NO: 815 - protein, 523 aa, Solanum lycopersicum
MAGGGGIGPGNGKEYPGELTLYVTMTCIVAAMGGLIFGYDIGISGGVTSMDTFLNRFFPSVYRKQKADNSTNQYCKFDSQTLTMFTSSLYLAALVSSLVASTVTRKLGRRLSMLSGGILFCAGALINGFAQNVAMLIIGRIFLGFGIGFANQSVPLYLSEMAPYKYRGALNIGFQLSITIGILVANVLNYFFAKIHWGWRLSLGGAMVPALIITIGSLFLPETPNSMIERGNHDEAKARLKRIRGIEDVDEEFNDLVIASEASRKIEHPWRNLLQKKYRPHLTMAIMIPFFQQLTGINVIMFYAPVLFKTIGFGTDASLMSAVITGGINVIATIVSIYYVDKLGRRFLFLEGGIQMLFSQIAVAILIAIKFGVNGTPGELPKWYAIVVVIFICVYVAGFAWSWGPLGWLVPSEIFPLEIRSAAQSINVSVNMIFTFAVAQVFLTMLCHLKFGLFLFFAFFVVIMTVFIYFFLPETKNIPIEEMVIVWKEHWFWSKFMTEVDYPGTRNGTAVEMAKGGAGYKIV

SEQ ID NO: 816 - protein, 242 aa, Solanum lycopersicum; identical to SEQ ID NO: 729

SEQ ID NO: 817 - protein, 250 aa, Solanum lycopersicum; identical to SEQ ID NO: 659

SEQ ID NO: 818 - protein, 315 aa, Solanum lycopersicum
MENFPIINLEKLNGDERANTMEMIKDACENWGFFELVNHGIPHEVMDTVEKMTKGHYKKCMEQRFKELVASKGLEAVQAEVTDLDWESTFFLRHLPTSNISQVPDLDEEYREVMRDFAKRLEKLAEELLDLLCENLGLEKGYLKNAFYGSKGPNFGTKVSNYPPCPKPDLIKGLRAHTDAGGIILLFQDDKVSGLQLLKDEQWIDVPPMRHSIVVNLGDQLEVITNGKYKSVLHRVIAQTDGTRMSLASFYNPGSDAVIYPAKTLVEKEAEESTQVYPKFVFDDYMKLYAGLKFQAKEPRFEAMKAMESDPIASA

SEQ ID NO: 819 - protein, 485 aa, Solanum lycopersicum
MVSISKNNQKQQLLSKIATNDGHGENSPYFDGWKAYANNPFHLTDNPTGVIQMGLAENQLCFDLIQEWVVNNPKASICTVEGAENFQDIAIFQDYHGLPEFRQAVARFMEKVRGDRVTFDPNRIVMSGGATGAHEMLAFCLADPGDAFLVPTPYYPGFDRDLRWRTGVQLFPVVCESCNDFKVTTKALEEAYEKAQQSNIKIKGLLINNPSNPLGTLLDKDTLRDIVTFINSKNIHLVCDEIYAATVFDQPRFISVSEIVEDMIECNKDLIHIVYSLSKDLGFPGFRVGIVYSYNDTVVNIARKMSSFGLVSTQTQHLLASMLSDEVFIDKFIAESSERLGERQGMFTKGLAEVGISTLKSNAGLFFWMDLRRLLKEATFDSELELWRIIINEVKLNVSPGCSFHCSEPGWFRVCFANMDDETMRIALKRISYFVLQPKGLNNIAAIKKQCSRRKLQISLSFRRLDHEFMNSPAHSPMNSPLVRT

SEQ ID NO: 820 - protein, 477 aa, Solanum lycopersicum
MGLISKIATNDGHGENSAYFDGWKAYENDPFHPTQNPNGVIQMGLAENQLCFDLIQEWIVNNPKASICTYEGVQDFQDTAIFQDYHGLPEFRKAVARFMEKVRGDRVRFDPERIVMSGGATGAHESLAFCLADPGDAFLVPTPYYPGFDRDLRWRTGVQLFPVVCESSNNFKVTKEALEEAYSKAQESNIKVKGLLINNPSNPLGTILDKETLKDILRFINDKNIHLVCDEIYAATAFSQPSFISISEVKSEVVGCNDDLVHIVYSLSKDLGFPGFRVGIIYSYNDAVVNIARKMSSFGLVSTQTQRLIASMLLDTIFVEDFIAKSSMRLLQRYGLFTKGLGQVGITTLKSNAGLFIWMDLRRFLENSTFDDELKLWHIIIDKVKLNVSPGCSFHCSEPGWFRVCFANMDDATMKIALRRIRHFVYLQPNKGVEVATKKQYCRTRSKLEISLSFRRLDDFMNSPHSPMSSPMVQARN

SEQ ID NO: 821 - protein, 483 aa, Solanum lycopersicum
MVSISKNNQKQQLLSKIATNDGHGENSPYFDGWKAYANNPFHLTDNPTGVIQMGLAENQLCFDLIQEWMVNNPKASICTVEGAENFQDIAIFQDYHGLPEFRQAVARFMEKVRGDRVTFDPNRIVMSGGATGAHEMLAFCLADPGDAFLVPTPYYPGFDRDLRWRTGVQLFPVVCESCNDFKVTTKALEEAYEKAQQSNIKIKGLLINNPSNPLGTLLDKDTLRDIVTFINSKNIHLVCDEIYAATVFDQPRFISVSEMVEEMIECNTDLIHIVYSLSKDLGFPGFRVGIVYSYNDTVVNISRKMSSFGLVSTQTQHMLASMLSDEIFVEKFIAESSERLGKRQGMFTKGLAQVGISTLKSNAGLFFWMDLRRLLKEATFDGELELWRIIINEVKLNVSPGCSFHCSEPGWFRVCFANMDDETMRIALRRIRNFVLQTKGLNNIAAIKKQCSRSKLQISLSFRRLDDFNSPAHSPMNSPLVRT

SEQ ID NO: 822 - protein, 829 aa, Solanum lycopersicum
MSGRRSSYTLLNQIPNDNFFQPPAPKFSAGAGVVPYGESSSAEKNRGKVFDLDLMDQRMMQSHNRVGSFRVPGSIGSQRQSSEGSFGGSSLSGENYVGTSFGHKNEGCGSSVARSWAQQTEESYQLQLALAIRLSSEATCADSPNFLDPVTDVLASRDSDSTASAVTMSHRLWINGCMSYFDKVPDGFYWIYGMDPYVWALCSVVQESGRIPSIESLRAVDPSKAPSVEVILIDRCNDLSLKELQNRIHSISPSCITTKEAVDQLAKLVCDHMGGAAPAGEEELVSMSKGCSNDLKDRFGTIVLPIGSLSVGLCRHRALLFKVLADIIDLPCRIAKGCKYCNSSDASSCLVRFEHDREYLVDLIGKPGVLSEPDSLLNGPSSISIPSPLRFPRYRQVEPTTDFRSLAKQYFLDSQSLNLLFDDSSAGAAADGDAGQSDRSCIDRNNVVSSSSNRDEISQLPLPPLNAWKKGRDKESQLSKMYNPRSMLNPVNMDEDQVLVKHVPPFREDAQSPMTRPDTVNDTRFLAGGGHVVSAIPSEELDLDVEEFNIPWNDLILMEKIGAGSFGTVHRGDWHGSDVAVKILMEQDFHAERLKEFLREVAIMKRLRHPNIVLFMGAVIQPPNLSIVTEYLSRGSLYRLLHKPGAREVLDERRRLCMAYDVANGMNYLHKRNPPIVHRDLKSPNLLVDKKYTVKICDFGLSRFKANTFLSSKTAAGTPEWMAPEVIRDEPSNEKSDVYSFGVILWELATLQQPWNKLNPPQVIAAVGFNRKRLDIPSDLNPQVAIIIEACWANEPWKRPSFSTIMDMLRPHLKSPLPPPGHTDMQLLS

SEQ ID NO: 823 - protein, 982 aa, Solanum lycopersicum
MKHIFKKLHHSNRSNDAQSTSSISSSSSPASSLSSASCTTDHRNSNSVSQSPLSPSTISTASTTTTPAAPVGAGGGGGGGNLSTINRQQDYYTSEEEYQVQLALALSVSSSQSQDPFPSDVNSSNGHGVGRTAVDLARDREDAAADLLSRQYWDYGVMDYEEKVVDGFYDVYNLFTDPASRGKMPSLSELETNPGTSNFEGVIINQRIDPSLEELMQIAHCITLDCPASEISLLVLRLSELVTGHLGGPVKDANIILAKWMEISTELRTSLHTSVLPIGSLKIGLSRHRALLFKVLADHVGIPCRLVKGSHYTGVEDDAVNIVKLPNDSEFLVDLMGAPGTLIPADVLSAKDASFNSPKLNKIPSLPSNSHSGVSYPRRNLLSGQNSVLGDDFSGRSKPEKIESVHSISDAGGSSTAGSSGINKRPSSNQVDWTSPLAIGTSLYKGGRGPNAAGDGLRLNVNVVPYDQNNPEDPKNLFADLNPFQIKGSGNTLLQKNPARNKVSELQQPINTLIPGRPPAPMMWKNRYAPNEVPRKNESDSEGLFPKKNGGSSGYNISSIASTSSNIPQKSSTDTSRLHGNSRPAYRGNDEVASTRNNSSILSAELEFRRLSVQNSQNNNRETSQWEGHSLQSDDLNRTQAYGDDIIVESDHTRNLQAQSIGTNIKLKEPENPTSSGNLGPSQVDPVFDDVGDCEIPWEDLVIGERIGLGSYGEVYHADWNGTEVAVKKFLDQDFSGAALAEFKREVRIMRRLRHPNVVRFMGAITRPPHLSIITEFLPRGSLYRIIHRPHFQIDERQRIKMALDVAKGMDCLHTSNPTIVHRDLKSPNLLVDTDWNVKVCDFGLSRLKHNTFLSSKSTAGTPEWMAPEVLRNEPSNEKCDIYSFGVILWELATLRLPWSGMNPMQVVGAVGFQNKRLEIPKELDPIVARIIWECWQTDPNLRPSFAQLTVALTPLQRLVIPAYVDQLNSRLPQEISVNSTP

SEQ ID NO: 824 - protein, 605 aa, Solanum lycopersicum
MMMFEEMGFCGDLDFFPAPLKEVEVAAPQTEAEQVVDDDYSDEDIDVDELEKRVWRDKMKLKRLKEMNQGMEDVDSVKRRQSQEQARRKKMSRAQDGILKYMLKMMEVCKAQGFVYGIIPEKGKPVGGASDNLREWWKDKVRFDRNGPAAIAKYQAEHAIPGKNDVSNPVGPTPHTLQELQDTTLGSLLSALMQHCDPPQRRFPLEKGVSPPWWPTGQEDWWPQLGLQKDQGPPPYKKPHDLKKAWKVGVLTAVIKHISPDIAKIRKLVRQSKCLQDKMTAKESATWLAIINQEEALARELYPDRCPPLSSAGGSGTFTVNDSSEYDVDGAQDECNFDVQEQKPHHLNLLNVTVERFNERQPLQQQSHPIKDEIITSLDFTRKRKQSNEQTVTMAQIYTCEILQCPYSELRHGFQDRSARDNHQLVCPYRNTSQFGVSKFPMNEVKPVVLPQQYIPSTSVALPVNPSPPPFDLFGVGVPEDGQRMIDDLMSFYDCNIQGNKSQNTGNVAVTKEQQPHQQPRVDQVNYLHSRGMMEGNIFKDINVSASQSMQPQGNLVDQCKILNSSDNLQFMFGPPFNLQSTNYPGSLPGIGCDTTPKQDIPIWY

SEQ ID NO: 825 - protein, 1316 aa, Solanum lycopersicum
MESETLTREYRRPSMLQRVLSASVPMLLIAVGYVDPGKWAAMVDGGARFGFDLVMLVLLFNFAAILCQYLSACIALVTDRDLAQICSEEYDKVTCIFLGIQAEVSMIALDLTMVLGTAHGLNVVFGVDLFSCVFLTATGAILFPLLASLLDNGSAKFLCIGWASSVLLSYVFGVVITLPETPFSIGGVLNKFSGESAFALMSPLGASIMPHNFYLHSSIVQQGKESTELSRGALCQDHFFAIVFIFSGIFLVNYAAMNSAANVSYSTGLLLLTFQDTLSLLDQVFRSSVAPFTIMLVTFISNQVTPLTWDLGRQAVVHDLFGMDIPGWLHHVTIRVISIVPALYCVWSSGAEGLYQLLILTQVVVALVLPSSVIPLFRVASSRSIMGIHKISQLMEFLSLGTFIGLLGLKIIFVIEMIFGNSDWVNNLKWNIGSSVSTPYFFLLIAASLCLCLMLWLAVTPLKSASSRFDAQAFLQTHVPEPYSECNQLGASNAMFGLVEGSSQKQEGAFHVEKSLVSHPDLSTKDPDQLLPESLLDFEKVHQLATIDESKSETTFSAPAVVHPEVPVSAGASPSVKSVCNEVSGVVSVDTSVFNTETVDVAEKTLRIEGDMANDRDDGDSWEEPEEAIKGVSENAQSFISDGPGSYKSLSGKLEDTGSGTGSLSRLAGLGRAARRQLTEALNEFWGQLFDYHGVATAEAKSKKLDIILGLDSKMNPKPAPASLKVESSAYIPSGSARIPEPLINSHVYSPKQQFASNIVDSAYRVPKEPSSTSSMWSNHMKLVGAYVQSSNSNMLDSGERRYSSMRIPATSAGYDQQPATVHGYQITAYLNQLAKERGSDYLNGQLESPSPRSVSSLTSNYAEPLARVSGQKPQSGVSSRAPPGFGNVPVGRNNSMQPTNTTSVDHSSTETAESVAGSANSKKYYSLPDISGRYVPRQDSIVSDARAQWYNSMGFGQSGGRSTYEQAYMSGSLRAGGPQRYEHSPKVCRDAFSLQYSSNSGTGSLWSRQPFEQFGVAGKPDVGSGDHGTVLSSSAQESTSTVDLEAKLLQSFRSCIVKLLKLEGSEWLFRQDDGADEDLIGRIAAREKFLYEAETREISRLTNIGESHFSSNRKPGSAPKPEEMDYTKFLVMSVPHCGEGCVWKVDLIISFGVWCIHRILELSLMESRPELWGKYTYVLNRLQGIVDLAFSKPHSPTSHCFCLQIPAGRQQKASPPPISNGNLPPQAKQGRGKCTTAAMLLEMIKDVETAISCRKGRTGTAAGDVAFPKGKENLASVLKRYKRRLSNKPVGNQEVAGVAGPRKVTLSASSPPFVL

SEQ ID NO: 826 - protein, 224 aa, Solanum lycopersicum; identical to SEQ ID NO: 567

SEQ ID NO: 827 - protein, 260 aa, Solanum lycopersicum; identical to SEQ ID NO: 568

SEQ ID NO: 828 - protein, 635 aa, Solanum lycopersicum
MESCDCIEALLPTGDLLVKYQYLSDFFIAVAYFSIPLELIYFVHKSACFPYRWVLMQFGAFIVLCGATHFISLWTFFMHSKTVAVVMTISKMLTAAVSCITALMLVHIIPDLLSVKTRELFLKTRAEELDKEMGLIIRQEETGRHVRMLTHEIRSTLDRHTILKTTLVELGRTLDLAECALWMPCQGGLTLQLSHNLNNLIPLGSTVPINLPIINEIFSSPEAIQIPHTNPLARMRNTVGRYIPPEVVAVRVPLLHLSNFTNDWAELSTRSYAVMVLVLPMNGLRKWREHELELVQVVADQVAVALSHAAILEDSMRAHDQLMEQNIALDVARQEAEMAIRARNDFLAVMNHEMRTPMHAVIALCSLLLETDLTPEQRVMIETILKSSNLLATLINDVLDLSRLEDGILELENGTFNLHGILREAVNLIKPIASLKKLSITLALALDLPILAVGDAKRLIQTLLNVAGNAVKFTKEGHISIEASVAKPEYARDCHPPEMFPMPSDGQFYLRVQVRDTGCGISPQDIPLVFTKFAESRPTSNRSTGGEGLGLAICRRFIQLMKGNIWIESEGPGKGTTVTFVVKLGICHHPNALPLLPMPPRGRLNKGSDDLFRYRQFRGDDGGMSVNAQRYQRSL

SEQ ID NO: 829 - protein, 761 aa, Solanum lycopersicum
MLRTLASALLVLSFFVSLSAADNGFPRCNCDDEGFWSIESILECQKISDLFIAIAYFSIPIELLYFVSCSNFPFKWVLFQFIAFIVLCGMTHLLNFWTYYGQHPFQLMLALTIFKVLTALVSFATAITLITLFPMLLKVKVREFMLKKKTWDLGREVGLIKMQKEAGWHVRMLTQEIRKSLDRHTILYTTLVELSKTLDLHNCAVWKPNENKTEMNLIHELRDSSFNSAYNLPIPRSDPDVIQVKESDGVKILDADSPLAVASSGGSREPGAVAAIRMPMLKVSNFKGGTPELVPECYAILVLVLPSEQGRSWCSQEIEIVRVVADQVAVALSHAAILEESQHMRETLEEQNRALEQAKQDALRASQARNAFQMVMSHGLRRPMHSILGLLSLLQDEKLGNEQRLLVDSMVKTSNVVSTLIDDVMDTSTKDNGRFPLEMRYFQLHSMIKEAACLAKCLCAYRGYNISIEVDKSLPNHVLGDERRVFQVILHMVGNLLKDPNGGLLTFRVLPESVSREGIGGAWRTRRSNSSRDNAYIRFEVGTSNNHSQPEGTMLPHYRPKRCSKEMDEGLSFTVCRKLVQLMQGDIWVIPNPEGFDQSMAVVLGLQLRPSIAIGIPEYGESSDHSHPHSLLQGVKVLLADYDDVNRAVTSKLLEKLGCSVSAVSSGRDCIGVLSPAVSSFQIVLLDLHLPDLDGFEVTMRIRKFGSHNWPLIVGLTATADENVTGRCLQIGMNGLIRKPVLLPGIADELQRVLLRGSRMM

SEQ ID NO: 830 - protein, 761 aa, Solanum lycopersicum; identical to SEQ ID NO: 829

SEQ ID NO: 831 - protein, 754 aa, Solanum lycopersicum; identical to SEQ ID NO: 809

SEQ ID NO: 832 - protein, 363 aa, Solanum lycopersicum; identical to SEQ ID NO: 794

SEQ ID NO: 833 - protein, 485 aa, Solanum lycopersicum; identical to SEQ ID NO: 611

SEQ ID NO: 834 - protein, 476 aa, Solanum lycopersicum; identical to SEQ ID NO: 613

SEQ ID NO: 835 - protein, 511 aa, Solanum lycopersicum
MENGTKGKLTVSSSLQIEQPLPPSKLWKIIVVASIAAGVQFGWALQLSLLTPYVQLLGIPHRFASFIWLCGPISGMIVQPVVGYYSDNCSSRFGRRRPFIAAGAALVTIAVFLIGFAADLGHASGDPLGKGSKPRAIAVFVVGFWILDVANNMLQGPCRALLADLSGGKSGRMRTANAFFSFFMAVGNILGYAAGSYSRLFKVFPFSKTKACDMYCANLKSCFFIAIFLLLSLTTLALTLVRENELPEKEELEIDEKLSGAGKSKVPFFGEIFGALKSLPRPMWILLLVTCLNWIAWFPFFLYDTDWMAKEVFGGQVGDAKLYDLGVRAGALGLLLQSVVLGFMSLGVEFLGKKIGGAKRLWGILNFVLAICLAMTILVTKMAEKSRRHDAAGTLMGPTPGVKIGALLLFAALGIPLAVTFSIPFALASIFSSNAGSGQGLSLGVLNLAIVVPQMLVSLVGGPWDDLFGGGNLPGFVVGAVAAAASGVLALTMLPSPPADAKPAVAMGGFH

SEQ ID NO: 836 - protein, 183 aa, Solanum lycopersicum
MGKNKFLGSCQKHEAFFLFLSLFNLTFYGSTAQNLIQPTSSLQAAPASQRATLPGIGMTSIRLVQYNVSDTMSHVKMLLLKDKQLDSHNTSCLKACLEVYSNAIASIKHATKSYNTKQYYDANIQISAVIADATTCEDGFMEKQGGVSPLTKRNDNTIQLSSVALSVVNFMFYNRSMEFKLTR

SEQ ID NO: 837 - protein, 186 aa, Solanum lycopersicum
MKPLFSLFLTLSLFLSLFFHGSKGQNLIQNTCKSCANDDPNIKYGFCTSSLQAAPASQCATLRGLGMISIRLIRYNVTDTRCHVKILLKEQKLDPYVKSCLSDCLELYTDAIPSIKLAMKSYNSKKYYDANIQISSVMDAATTCEDGFKDKDGVVSPLTKLNENTFQLSAMALSLMNLIKNNNTNG

SEQ ID NO: 838 - skipped

SEQ ID NO: 839 - protein, 613 aa, Solanum lycopersicum
MAAISGKVVQHNLVAKCCQQDRELSTKYRLYYCTLSRRNLLPPVGGKLAWNGNSTMQLDALSKSKRGNVYCNAASSSTAIPSVEKSNFLKLQNGSDIRGVAIDGVEGEPLTLTETVTEAIAAGFSGWLLAKKKNVSSKCLRVSVGHDSRISAQKLQDAVSRGLARAGVEVIQYGLASTPAMFNSTLTENEEFSCPVDGSIMITASHLPYNRNGFKFFTSAGGLGKPDIKDILERAADIYKNIANENSKGAETAASLDVKRVDYMSVYASNLVAAVRKAAGSIEKPLEGFHIIVDAGNGAGGFFVGKVLEPLGAITSGSQFLEPDGLFPNHIPNPEDKTAMKAITKAVLDNRADLGIIFDTDVDRSAAVDSSGREFNRNRLIALMSAIVLEEHPGTTIVTDSVTSDGLTTFIEKKLGGKHHRFKRGYKNVIDEAIRLNSVGEEAHLAIETSGHGALKENHWLDDGAYLMVKLLNKLASARTSGLGGGSKVLTDMVEGLEEPAVAVELRLKIDQNHPDLQGGSFRDYGEAVLKQLENTVELDAKLLKAPVNYEGVRVSGFGGWFLLRLSLHDPVLPLNIEAPSKEDAVKLAHDVLNAVKEFTALDTSALTKFVGV

SEQ ID NO: 840 - protein, 613 aa, Solanum lycopersicum; identical to SEQ ID NO: 839

SEQ ID NO: 841 - protein, 1824 aa, Solanum lycopersicum
METGQGSSWIPATPGKPSFAESPPICSTGQENQQAQVDLSDLQRKQAVEHANGSTAEAQNAVEHANGSTAEAQNAAANRGSTSSVEDQCFTTSEAVVGTKSEMCGGGINMYNNFPSDNVELWSSMSFGDLLAMAHAGGSGTTPADETAYSVKSSFQPLINTQNADESSILSSFPFNLNSPPKMTGATLSSNIQFQFEPVTPDMMKIKGQASNASNLDINVTTAARVIQSNEDIIKGAEANELQQNKEQSVLILEGKLDTELNNTPEQKTRRRKHRPKVVVEDKPKRTPKPKIQKQPGAEETKTEKRKYVRRNKVGEPTATFADEVSNTICHEGKPPSSEKTPTAKRKYVRRNQVNKSTEKPSEEGSSVTIGTPAATSTEEVKNTTFHVGKAPSSEETPTAKRNVRTNQVNMSMEKLSEEGSSGTNDPSEVPHSRKSCRKSLSFELESQASDEYSSYRPSTLDLHANNSGSTAQSVQLGQGKETTSEETEMGITHNITRSLNQEVRNYLSQPRMQYPSPPTPDKVGWNHDKTMVGNHNESTRGNSRIIFSDVTHDKQASILQMTPQSLNSNCGSSSCLPHGKGLKRQHSCRTDEAQFYSINAKGTYFNSMQAYQAILPANKPDVYSNVGMHFPAIYKKMRAEKGHISTSSYIKLFTGETNYVSSSQCYISGSPSNNSATNIGNYGMWNSNVMPAFVEAERLRNKISNGPTQVHDIASLHEIYKQFPTSTSKELTKYGFGERYKTSHLSSACMGTPIADTQAATKKKRQSKKSILVSSAASNLYTHQHVAKNARGSLPALTWRGMSPIDEIAERLRLLDLNRESSQNQGPHGITYHTKFQRESALVLYQRDGSIVPFGSSLVRKRKPRPKVDVDDETDRVWKLLLQDINSEGIDGTDEDKAKWWEEERRVFNSRADSFIARMRLVQGDRRFSPWKGSVVDSVVGVYLTQNVSDHLSSSAFMSLAAHFPLKTDSTQKHEGNTGIIIEEPEECATDPNVSIRWYEDQPNQSTHCQDSSGVYNTDSNEEKPAVNDSESSENSTECIKSAECSVILQSDSSREGSDLYHGSTVTSSQDRKELNDLPSSPSSVVSSEISAVIQASEGTDSSNFCSSTSFLKLLQMAGTSGAQGTRCTEHLQEGENVPFLEKELISPKKSVLSAESAHSALYTTPQNKLDIETMTDAEDNVELQFPTEDSNSNVQQVPEAPACSETIVNVTERASIVFDSCKPEQRGLESSLKNDSNHVRSKVDKVNDNPSKAKNGQLGKEKENIDWDSLRLQAQANGKKRERTANTMDSLDYEAVRCANVNEIAHTIRERGMNNKLAERIQAFLNRIVSDHGSIDLEWLRDVPPDKAKEYLLSIRGLGLKSVECVRLLTLHHLAFPVDVNVGRIAVRLGWVPLQPLPESLQLHLLELYPILESIQQYLWPRLCKLDQRTLYELHYHMITFGKVFCTKSKPNCNACPLRGECRHFASAFASARLALPAPEEKSIVSATEQKATNNNPRENFTHLPLPLPPGNQQPVENQKLINSAPIIEVPATPEPIVEVPSTPEQEQIKAPEIDIEDAYFEDTNEIPMIELNMAEFTQNVKKYVENNMELHQVEMSNALVALTSEAASIPTPKLKNVSRLRTEHQVYELPDSHPLLEGLDKREPDDPSSYLLAIWTPGETANSMQPPETQCNSQESGELCEDETCSSCNSIREAQSQTVRGTLLIPCRTATRGSFPLNGTYFQVNEVFADHDSSLNPINVPRDWLWNLPRRTVYFGTSIPTIFKGLNTESIQHCFWRGFVCVRGFDHKTRAPRPLLARFHFPASKLNRTNGKTNEDKGVAS

SEQ ID NO: 842 - protein, 859 aa, Solanum lycopersicum
MSLGGIVDAILGKDDRPKVKGRVILMKKNVLDFINIGASVVDGISDLLGQKVSIQLISGSVNYDGLEGKLSNPAYLESWLTDITPITAGESTFSVTFDWDRDEFGVPGAFIIKNLHLNEFFLKSLTLEDVPNYGKIHFVCNSWVYPAFRYKSDRIFFANQAYLPSETPQPLRKYRENELVALRGDGTGKLEEWDRVYDYACYNDLGEPDKGEEYARPILGGSSEYPYPRRGRTGREPTKADPNCESRNPLPMSLDIYVPRDERFGHVKKSDFLTSSLKSSLQTLLPAFKALCDNTPNEFNSFADVLNLYEGGIKLPEGPWLKAITDNISSEILKDILQTDGQGLLKYPTPQVIQGDKTAWRTDEEFGREMLAGSNPVLISRLQEFPPKSKLDPTIYGNQNSTITTEHVQDKLNGLTVNEAIKSNRLFILNHHDIVMPLLRKINMSANTKAYASRTLLFLQDDRTLKPLAIELSLPHPDGDQFGTVSKVYTPADQGVEGSIWQFAKAYVAVNDMGIHQLISHWLNTHAVIEPFVIATNRHLSVLHPIHKLLHPHFRNTMNINALARETLTYDGGFETSLFPAKYSMEMSAAAYKDWVFPEQALPADLLKRGVAVEDLSSPHGIRLLILDYPYAVDGLEIWAAIKSWVTEYCKFYYKSDETVEKDTELQAWWKELREEGHGDKKDEAWWPKLQTRQELRDCCTIIIWIASALHAALHFGLYSYAGYLPNRPTLSCNLMPEPGSVEYEELKTNPDKVFLKTFVPQLQSLLEISIFEVSSRHASDEVYLGQRDSIEWTKDKEPLVAFERFGKMLSDIENRIMIMNSHKSWKNRSGPVNVPYTLLFPTSEEGLTGKGIPNSVSI

SEQ ID NO: 843 - protein, 896 aa, Solanum lycopersicum
MLKPQFQQSTKTLIPSWNTNTLFLASFPINILNKNFILKKKNNFRVHHNYNGANTIKAVLNSTQKSIGVKAVVTVQKQVNLNLLRGLDGIGDLLGKSLILWIVAAELDHKTGLEKPSIRSYAHRGLDVDGDTYYEAVFEIPEDFGEVGAILVENEHHKEMYVKNIVIDGFVHGKVEITCNSWVHSKFANPDKRIFFTNKSYLPSQTPSGVIRLREEELVTLRGDGVGERKVFERIYDYDVYNDLGEVDSNNDDAKRPILGGKKLPYPRRCRTGRQRSKKDPLYETRSTFVYVPRDEAFSAVKSLTFSGNTVYSALHAVVPALESVVSDPDLGFPHFPAIDSLFNVGVDLSGLSDKKSSLFNIVPRLIKSISETGKDVLLFESPQLVQRDKFSWFRDVEFARQTLAGLNPYSIRLVTEWPLRSNLDPKVYGPPESEITKELIENEIGNNMTVEQAVQQKKLFILDYHDLLLPYVNKVNELKGSVLYGSRTIFFLTPHGTLKPLAIELTRPPIDDKPQWKEVYSPNNWNATGAWLWKLAKAHVLSHDSGYHQLVSHWLRTHCCTEPYIIATNRQLSAMHPIYRLLHPHFRYTMEINALAREALINANGIIESSFFPGKYSVELSSIAYGAEWRFDQEALPQNLISRGLAEEDPNEPHGLKLAIEDYPFANDGLVLWDILKQWVTNYVNHYYPQTNLIESDKELQAWWSEIKNVGHGDKKDEPWWPELKTPNDLIGIITTIVWVTSGHHAAVNFGQYSYGGYFPNRPTTARSKMPTEDPTAEEWEWFLNKPEEALLRCFPSQIQATKVMTILDVLSNHSPDEEYIGEKIEPYWAEDPVINAAFEVFSGKLKELEGIIDARNNDSKLNNRNGAGVMPYELLKPYSEPGVTGKGVPYSISI

SEQ ID NO: 844 - protein, 414 aa, Solanum lycopersicum
MAYFQRLISCIFVLFLLSLAFACEARVLLDENNANDQGFVRVNGAHFELNGSPFLFNGFNSYWLMHVAAEPSERYKVSEVLREASSAGLSVCRTWAFSDGGDRALQISPGVYDERVFQGLDFVISEAKKYGIRLILSFVNNYNDFGGKAQYVQWARNAGAQINGDDDFYTNYITKNYYKNHIKKVVTRFNTITGMTYKDDSTIMAWELMNEPRNQADYSGNTLNAWVQEMASFVKSLDNKHLLEIGMEGFYGDSVPERKSINPGYQVGTDFISNHLIKEIDFATIHAYTDQWLSGQSDDAQMIFMQKWMTSHWQDAKNILKKPLVLAEFGKSSRDPGYNQNIRDTFMSTIYRNIYSLAKDGGTMGGSLIWQLVAQGMENYEDGYCIELGKNPSTAGIITSQSHAMTALAHLVKI

SEQ ID NO: 845 - protein, 401 aa, Solanum lycopersicum
  MOD_RES (324)..(324): Any amino acid
MSYTHRRSCISGLFLLLLALSCEANSGFIGVKDSHFELNGSPFLFNGFNSYWLMHVAADPAERYKVTEVLKDASTAGLSVCRTWAFSDGGDRALQISPGVYDERVFQGLDFVIAEAKKYGVRLILSFVNQWNDFGGKAEYVWWARNAGVQISNDDEFYTHPILKKYLKNHIEKVVTRLNSITKVAYKDDATIMAWELMNEPRDQADYSGKTVNGWVQEMASFVKSLDNKHLLEVGMEGFYGDSIPERKLVNPGYQVGTDFISNHLINEIDFATIHAYTDQWLSGQSDEAQLAWMEKWIRSHWEDARNILKKPLVLAEFGKSSRXSEGSRDIFMSSVYRNVYNLAKEGGTMEGSLVWQLMAHGMENYDDGYSIVLGLNPSTTQIISNQAHIMTALAHSLNHE

SEQ ID NO: 846 - protein, 491 aa, Solanum lycopersicum
MYSVVIRRLMATTPNTMSIKQGLSLWCPQSAVLNRISRVSVPSRSFRRSFVAASSFDNENREYVVVGGGNAAGYAARTFVEHGQANGKLCIVTKEPYAPYERPALTKAYLFPLDKKPARLPGFHTCVGAGGERQTPDWYKEQGIEMLYEDPVTGIDIEKQTLTTNSGKLLKYGTLIIATGCTASRFPEKIGGNLPGVHYIRDVADADSLISSLGKAKKLVVVGGGYIGMEVAAAAVAWKLDTTIIFPEEHLLSRLFTPSLAQKYEQLYQDSGVKFVKGAKIKHLESGPDSRVTAVKLEDGSSIETDTVVIGIGAKPAVSPFDMVGLNNTVGGIEVDGQFRTNIPGIFAIGDVAAFPLKIYNRIARVEHVDHARKSAQHCIKSLLTAHTHTYDYLPYFYSRVFEYEGSSRKVWWQFFGDNVGEAVEVGNFDPKVATFWIDSGKLKGVLLESGSPEEFQLLPKLARSQPSVDIAKLQNASSVEEALEIAQASL

SEQ ID NO: 847 - protein, 265 aa, Solanum lycopersicum; identical to SEQ ID NO: 789

SEQ ID NO: 848 - protein, 301 aa, Solanum lycopersicum; identical to SEQ ID NO: 598

SEQ ID NO: 849 - protein, 352 aa, Solanum lycopersicum
MEIYHQMQFDCGDPHLPPGFRFHPTDEELITYYLLKKVLDCNFTARAIAEVDLNKCEPWELPGKAKMGEKEWYFFSLRDRKYPTGLRTNRATEAGYWKATGKDREIFSSKTCALVGMKKTLVFYRGRAPKGEKSNWVMHEYRLDGKFAYHYISRSSKDEWVISRVFQKSTGSNGAATSTGGGKKRLSSSINMYQEVSSPSSVSHLPPLLDSSPYSTTATSAAAIVIGDRDRDHSFKKEHVPCFSTTATATITAQSLTFDPTSVFDISSNTLHALQPTPSFASILDSSPSNFTNYTRNSTFPSLRSLHENLQLPLFSGGTSAMHGGFSNPMVNWTVPETQKVEQSELDCMWSY

SEQ ID NO: 850 - protein, 631 aa, Solanum lycopersicum; identical to SEQ ID NO: 678

SEQ ID NO: 851 - protein, 604 aa, Solanum lycopersicum; identical to SEQ ID NO: 679

SEQ ID NO: 852 - protein, 653 aa, Solanum lycopersicum; identical to SEQ ID NO: 680

SEQ ID NO: 853 - protein, 594 aa, Solanum lycopersicum; identical to SEQ ID NO: 682

SEQ ID NO: 854 - protein, 412 aa, Solanum lycopersicum; identical to SEQ ID NO: 684

SEQ ID NO: 855 - protein, 242 aa, Solanum lycopersicum
MGRGKVELKRIENKINRQVTFAKRRNGLLKKAYELSILCDAEIALIIFSSRGKLYEFCSNSSMSKTLERYHRYNYGTLEGTQTSSDSQNNYQEYLKLKTRVEMLQQSQRHLLGEDLGQLGTKDLEQLERQLDSSLRQIRSTKTQHILDQLAELQQKEQSLTEMNKSLRIKLEELGVTFQTSWHCGEQSVQYRHEQPSHHEGFFQHVNCNNTLPISYGYDNVQPENAAPSTHDATGVVPGWML

SEQ ID NO: 856 - protein, 177 aa, Solanum lycopersicum; identical to SEQ ID NO: 695

SEQ ID NO: 857 - protein, 811 aa, Solanum lycopersicum; identical to SEQ ID NO: 620

SEQ ID NO: 858 - protein, 1106 aa, Solanum lycopersicum; identical to SEQ ID NO: 696

SEQ ID NO: 859 - protein, 389 aa, Solanum lycopersicum
MALHATAFSFTGVSTSSKSSRSALLSVFPLPRRCTVKATSQYPHSFPRCKIQGRALPSDNGLVEKDESSLVVCFGEMLIDFVPTTSGLSLAEAPAFKKAPGGAPANVAVGISRLGGSSAFIGKVGEDEFGYMLAEILKENNVNSDGMRFDPGARTALAFVTLRKDGEREFMFYRNPSADMLLQEDELDLELIRKAKVFHYGSISLITEPCKSAHIAAAKAAKDAGVILSYDPNLRLPLWPSAESAREGILSIWNTADIIKISEEEISFLTQGEDPYDDNVVRKLYHPNLKLLLVTEGPEGCRYYTKDFSGRVKGIKVDAVDTTGAGDAFVAGILSQLASDVSLLQDEGKLRDALSFANACGALTVMERGAIPALPTKEVVLNALLKSVA

SEQ ID NO: 860 - protein, 417 aa, Solanum lycopersicum; identical to SEQ ID NO: 701

SEQ ID NO: 861 - protein, 381 aa, Solanum lycopersicum; identical to SEQ ID NO: 745

SEQ ID NO: 862 - protein, 320 aa, Solanum lycopersicum
MQALVCAKMSRPFATAPLVVPVAHSLLPRHLRLSNLPLPSLTATTDTDIFRRRFFSPYNFRSVPGPVMAGLGGFDVIGDGGSMVQDAGATALVIAGAYAFVSTFDLLSERKLIEQNLSRKLVHILSGLLFMASWPIFSVSGRARYFAAVVPLTNCLRLVIHGLSLATDEGLVKSVTREGKPEELLRGPLYYVLVLILSAVLFWRESPVGVISLAMMCGGDGIADIVGRRFGSTKLPYNKQKSLVGSLSMFVVGFLVSIGMLYYFSALGYFQLDWVSTVERVALVSFVATMVESLPITGMVDDNISVPLVSMVVASLAFAY

SEQ ID NO: 863 - protein, 159 aa, Solanum lycopersicum; identical to SEQ ID NO: 707

SEQ ID NO: 864 - protein, 604 aa, Solanum lycopersicum
MDAVSIRVPYKNLKQQEVELTNVDESRFAQLEIRSDSSSPRVSNGEMNDSNLPLPPPPVRNSLLTLILSCTVAAGVQFGWALQLSLLTPYIQTLGIEHAFSSFIWLCGPITGLVVQPCVGIWSDKCHSKYGRRRPFIFIGAVMISIAVIIIGFSADIGYLLGDTKEHCSTFKGTRSRAAIVFVVGFWMLDLANNTVQGPARALLADLSGPDQRNTANAVFCSWMAVGNILGFSAGASGGWHRWFPFLTNRACCEPCGNLKAAFLVAVVFLTLCTLVTLYFANEVPLSPKQYKRMSDSAPLLDSPQNTGFDLSQSKRELQYANSVANNESEMGHVADNSPKNEEQRPDKDQGDSFADSPGAVLVNLLTSLRHLPPAMHSVLIVMALTWLSWFPFFLFDTDWMGREVYHGDPKGEADEVNAYNQGVREGAFGLLLNSVVLGVSSFLIEPMCKWIGSRLVWAVSNFIVFVCMACTAIISVVSISANTQGVQHVIGATRSTQIAALVVFSLLGIPLAVTYSVPFSITAELTADAGGGQGLAIGVLNLAIVVPQMVVSLGAGPWDALFGGGNIPAFALASLAALAAGIFAMLRLPNLSSNFKSTGFHFG

SEQ ID NO: 865 - protein, 269 aa, Solanum lycopersicum; identical to SEQ ID NO: 710

SEQ ID NO: 866 - protein, 245 aa, Solanum lycopersicum; identical to SEQ ID NO: 716

SEQ ID NO: 867 - protein, 724 aa, Solanum lycopersicum
MLRTNVLLLLVICLLDFFSSVKASVSYDDRAIIINGKRKILISGSIHYPRSTPQMWPDLIQKAKDGGLDVIETYVFWNGHEPSPGKYNFEGRYDLVRFIKMVQRAGLYVNLRIGPYVCAEWNFGGFPVWLKYVPGMEFRTNNQPFKVAMQGFVQKIVNMMKSENLFESQGGPIIMAQIENEYGPVEWEIGAPGKAYTKWAAQMAVGLKTGVPWIMCKQEDAPDPVIDTCNGFYCEGFRPNKPYKPKMWTEVWTGWYTKFGGPIPQRPAEDIAFSVARFVQNNGSFFNYYMYHGGTNFGRTSSGLFIATSYDYDAPLDEYGLLNEPKYGHLRDLHKAIKLSEPALVSSYAAVTSLGSNQEAHVYRSKSGACAAFLSNYDSRYSVKVTFQNRPYNLPPWSISILPDCKTAVYNTAQVNSQSSSIKMTPAGGGLSWQSYNEETPTADDSDTLTANGLWEQKNVTRDSSDYLWYMTNVNIASNEGFLKNGKDPYLTVMSAGHVLHVFVNGKLSGTVYGTLDNPKLTYSGNVKLRAGINKISLLSVSVGLPNVGVHYDTWNAGVLGPVTLSGLNEGSRNLAKQKWSYKVGLKGESLSLHSLSGSSSVEWVRGSLVAQKQPLTWYKATFNAPGGNDPLALDMASMGKGQIWINGEGVGRHWPGYIAQGDCSKCSYAGTFNEKKCQTNCGQPSQRWYHVPRSWLKPSGNLLVVFEEWGGNPTGISLVRRSR

SEQ ID NO: 868 - protein, 582 aa, Solanum lycopersicum; identical to SEQ ID NO: 777

SEQ ID NO: 869 - protein, 404 aa, Solanum lycopersicum
MSTLFFTFSLLLLAPLLVISSIQDPELVVQDVHRSINASLTRRNLGYLSCGSGNPIDDCWRCNPNWEKNRQRLADCAIGFGKNAIGGKNGRIYVVTDSGNDDPVNPKPGTLRHAVIQDEPLWIIFKRDMVIQLKQELVMNSYKTIDGRGASVHISGGPCITIHHTSNIIIHGINIHDCKQSGNGNIRDSPNHSGWWDVSDGDGISIFGGKNIWVDHCSLSNCHDGLIDAIHGSTAITISNNYFTHHDKVMLLGHSDSFTQDKGMQVTVAFNHFGEGLVQRMPRCRHGYFHVVNNDYTHWEMYAIGGSAAPTINSQGNRFLAPNEKYRKEVTKHEDAPESQWRSWNWRSEGDLMLNGAYFRQTGAGASSSSTYARASSLSARPSSLVGSITTNAGPVNCKKGSRC

SEQ ID NO: 870 - protein, 320 aa, Solanum lycopersicum
MESNFPVVDMGLLQTEKRPEAMDKIKDACENWGFFELVNHGISHELLDTVENLTKGHYKKCMEQRFKEMVASKGLEAVQTEIDDLDWESTFFLKHLPVSNVYEVPDLDDEYRKVMKDFALKLEKLAENLLDLLCENLGLEKGYLKKAFYGSKGPTFGTKVSNYPPCPKPDLIKGLRAHTDAGGIILLFQDDKVSGLQLLKDGNWIDVPPMKHSIVINLGDQLEVITNGRYKSIEHRVIAQQDGTRMSIASFYNPGSDAVIFPAPELIEKTEEDNKLKYPKFVFEDYMKLYAGLKFQAKEPRFEAMKAVETTVNLGPIETV

SEQ ID NO: 871 - protein, 471 aa, Solanum lycopersicum
MLKMLSKMAMCKSHGQDSSYFIGWQEYEKNPYDPLQNPSGIIQMGLAENQLSFDLIESWLTRNQDVIQFRENGGSMFRDLALFQDYHGLQAFKNVLVSLMAEIRRKKVKFDPKNLVLTAGSTSANETLIFCLAEPGEALLIPTPYYPGFDRDLKWRTGAEIVPIQCYSSNNFRITESALEEAYEQAQKRNLTVKGVFITNPSNPLGTTMSRNELNILITFAMTKNIHIVSDEIYAGTVFDSPKFVSIIEALIDRKLEKSKMWNQVHIVSSLSKDLGLPGFRVGMIYSNNETLIAAATKMSSFGLISSQTQYLLSKILGDRRFIKRYVKQNKKQLIHRREMLASGLANSGIECLDSNAGLFCFVDMRDLLNSNTFEAEMELWKKIISNVGLNVSPGSSCHCSEPGWFRVCFANMSKETLDLAMQRINNFVNFDRDIHRQQPLRFVTGAGSRRRRTIANWVVKFSSGDGRRDR

SEQ ID NO: 872 - protein, 477 aa, Solanum lycopersicum; identical to SEQ ID NO: 820

SEQ ID NO: 873 - protein, 721 aa, Solanum lycopersicum
MPALGCCVDASVSPPLGYAFSWDSSLPAPELFSSGVPPATNAAAVSTGSHWSTDLSSDLYRVDGWGAPYFSVNSSGDISVRPHGTDTLPHQEIDLLKVVKKASDPKNLGGLGLQMPLVVRFPDVLKNRLETLQSAFDMAINSQGYEAHYQGVYPVKCNQDRFVVEDIVKFGSPYRFGLEAGSKPELLLAMNCLSKGSADALLVCNGFKDTEYISLALVARKLLLNSVIVLEQEEELDLVIDISRKMSVRPVIGLRAKLRTKHSGHFGSTSGEKGKFGLTTTQILRVVKKLDESGMLDCLQLLHFHIGSQIPTTELLADGVGEATQIYSELVRLGAGMKFIDIGGGLGIDYDGSKSSNSDVSVCYSIEEYASAVVQAVLYVCDRKGVKHPVICSESGRAIVSHHSILIFEAVSASTSHVSTQPSSGGLQSLVETLNEDARADYRNLSAAAVRGEYDTCLIYSDQLKQRCVEQFKDGSLDIEQLAAVDSICDWVSKAIGVADPVRTYHVNLSVFTSIPDFWGFSQLFPIVPIHRLDEKPTMRGILSDLTCDSDGKVDKFIGGESSLPLHEIGSGDGGRYYLGMFLGGAYEEALGGLHNLFGGPSVVRVMQSDSPHSFAVTRSVPGPSCADVLRAMQFEPELMFETLKHRAEEFLEQGEGEGEGVAFGSLTSSLAQSFHNMPYLSSCCFTAEATANANTNTNNGGYYYYSEDNAAAEEDEIWSY

SEQ ID NO: 874 - protein, 707 aa, Solanum lycopersicum
MPALGCCVESAVSPPLGYSFLSTPEIFSSGVPPSTNAVPLTTHWSPELSSDLYRIDGWGAPYFTVNSSGDISVRPHGTDTLPHQEIDLLKVVKKASDPINSGGLGLQLPLVVRFPDVLKNRLESLQSAFDYAVQSEGYEAHYQGVYPVKCNQDRFVVEDIVKFGTGFRFGLEAGSKPELLLAMSSLCKGSSEGLLVCNGFKDAEYISLALVARKLQLNTVIVLEQEEELDLVIDISRKMAVQPVIGLRAKLRTKHSGHFGSTSGEKGKFGLTTTQILRVVRKLKESGMLDCLQLLHFHIGSQIPSTELLADGVGEAAQVYSELVRLGAGMKFIDIGGGLGIDYDGTKSSDSDVSVGYGLQDYASTVVQAVRFVCDRKNVKHPVICSESGRAIVSHHSVLIFEAVSSTTTRSQELSSMSLHSFVEKLNDDARGDYRNLSAAAIRGEYDTCMLYADQLKQRCVDQFKDGNLDIEQLAAVDAVCDFVSKAIGASDPVRTYHVNLSVFTSIPDFWAIDQLFPIVPIHKLDEHPSARGILSDLTCDSDGKIDKFIGGESSLALHELGSGNSAPYYLGMFLGGAYEEALGGLHNLFGGPSVLRVSQSDSPHSFAVTYAVPGPSCADVLRAMQHEPELMFETLKHRAEEFVHKEEEVEVSLANSLNQSFHNMPYLAPHSSCCFSGYYYCNDENIVGVGAECAIGEEEFWPYCVA

SEQ ID NO: 875 - protein, 381 aa, Solanum lycopersicum
MGEALKYSIMDSVRSVVFKESENLEGSCTKIEGYDFNKGVNYAELIKSMVSTGFQASNLGDAIAIVNQMLDWRLSHELPTEDCSEEERDVAYRESVTCKIFLGFTSNLVSSGVRDTVRYLVQHRMVDVVVTTAGGIEEDLIKCLAPTYKGDFSLPGASLRSKGLNRIGNLLVPNDNYCKFENWIIPVFDQMYEEQINEKVLWTPSKVIARLGKEINDETSYLYWAYKNRIPVFCPGLTDGSLGDMLYFHSFKKGDPDNPDLNPGLVIDIVGDIRAMNGEAVHAGLRKTGMIILGGGLPKHHVCNANMMRNGADFAVFINTAQEFDGSDSGARPDEAVSWGKIRGGAKTVKVHCDATIAFPILVAETFAAKSKEFSQIRCQV

SEQ ID NO: 876 - protein, 300 aa, Solanum lycopersicum
MAIMDEAANMVCVPLDYSRKRKSRSRRDRTKNVEETLAKWKEYNEKLDNEGKGKPVRKVPAKGSKKGCMRGKGGPENWRCKYRGVRQRIWGKWVAEIREPKRGSRLWLGTFGTAIEAALAYDDAARAMYGPCARLNLPNYACDSVSWATTSASASASDCTVASGFGEVCPVDGALHEADTPLSSVKDEGTAMDIVEPTSIDEDTLKSGWDCLDKLNMDEMFDVDELLAMLDSTPVFTKDYNSDGKHNNMVSDSQCQEPNAVVDPMTVDYGFDFLKPGRQEDLNFSSDDLAFIDLDSELVV

SEQ ID NO: 877 - protein, 1316 aa, Solanum lycopersicum; identical to SEQ ID NO: 825

SEQ ID NO: 878 - protein, 754 aa, Solanum lycopersicum; identical to SEQ ID NO: 809

SEQ ID NO: 879 - protein, 229 aa, Solanum lycopersicum; identical to SEQ ID NO: 648

SEQ ID NO: 880 - protein, 183 aa, Solanum lycopersicum; identical to SEQ ID NO: 836

SEQ ID NO: 881 - protein, 186 aa, Solanum lycopersicum; identical to SEQ ID NO: 837

SEQ ID NO: 882 - protein, 558 aa, Solanum lycopersicum
MASTCLDVSFLGNFCNNWSFRPCTRLTPCISQVRNSLLLGKNKNYTSSVGYKGIPLTEISCVPSAVASSSELPPLVSALKASAEENAASFHFPGHNRGQAAPSSLTQLIGAKPFLHDMPELPELDNLFSPEGPILEAQKEAARLFGALETWFLVGGSTCGVHAAIMATCSPGDTLILPRNSHISAISAMVLSGALPKYIVPEYDFKWDVAGGITPSQVNDAIKELEMEGRKAAALLVVSPTYHGICSNLDEICHICHSYNIPVIVDEAHGAHLGFHPELPSSSLSQGADLAVQSTHKVLCSLTQSSMLHMQGNLVNRERISKSLQMLQSSSPSYLLLASLDAARAQLSENREAVFDKAMDLALEARSLISKIPGISIIEFPSFSSFFQIDPLRLTIGVWQLGLSGFEADDILCNDFGVVCELVGTKSFTLAFNLGTQRDHVLRLVAGLNHLSQTSHFPQPVKEEGKNVNHFVCLDDIRIRMSPREAFFATKRKVSIRDSLGEICGELVCPYPPGIPVLIPGEIITAEALNYLLEIRSKGAVITGAADFSLSSFVVCVT

SEQ ID NO: 883 - protein, 534 aa, Solanum lycopersicum
MFLSIISPFHKIGCGSTFVKQSITRRATPEQQEHDSLIMGPREQEVLPPLVNAIKTSVKKNSAPFHFPGHKRGMAAPSSLVDVIGIGPFLHDATELPELDRFSYPTGPLLEAQKMAADLFGASQTWFIVCGTTCGILAAIMSTCSPGDTLILARNSHVSATSAMVLCGALPKYILPEYNLQWDTAGGVTPSQVKIAIEELEQEGKKAAGVFITSPTYNGVCSNISEISQICHSHGIPLIVDEAHGSHFKFHPDMPKTALSQGADLVIQSTHKVLCSFSQSSMLHLSGDSIDRDRVHKCLQSLHTTSPNWVLLASLDATRDELSKNPNTLFSEVMELVQQVKELINHIPGVSLLDLSCFSNNFSFMDPLRMTIGVQELGLSGLEAYNILSTSHGIQPELIGTQSFTLAFSLGTTKEHTQRLVSGLKYLSINFFQEEREIIKIDHGMDRVPFGEVYMSCTPREAFFAKKKKVNFEKSIGEVCGEFICPFPPGIPMLIPGEIITKRAMDYLIRVKDKGAFLKGAADPLLSTVVVCDF

SEQ ID NO: 884 - skipped

SEQ ID NO: 885 - protein, 150 aa, Solanum lycopersicum
MSTVRLPSTCMFKAAPLSERKSAFVKMPFSVGSVRNISKSFGLKADSSFRVSANVYKVKLVCPDGTEHEFEAPSDTYILDAAENAGVDLPYSCRAGACSTCAGKIESGTVDQSDGSFLDDNQIKEGYLLTCVSYPNSDCVIHTHKEGDLY

SEQ ID NO: 886 - protein, 144 aa, Solanum lycopersicum
MASIPSTIVNTSFLPRRSVVTSLKSIPNVGESLFGLKSGRSGRITCMATYKVKLITPEGPFEFDCPDDVSILDRAEETGLDLPYSCRAGACSSCAGKVTAGSVDQSDNSFLDDDQIDEGFVLTCVAYPKSNVTIQTHKEEDLVG

SEQ ID NO: 887 - protein, 276 aa, Solanum lycopersicum
MGSFTHYGFLMLALLFSSCMVTYGGNFYQEFDFTWGGNRAKIFNGGQLLSLSLDKVSGSGFQSKKEHLFGRIDMQIKLVAGNSAGTVTTYYLSSQGPTHDEIDFEFLGNVTGEPYILHTNIYAQGKGNKEQQFYLWFDPTKNFHTYSIIWKPQHIIFLVDNTPIRVYKNAESVGVPFPKNQPMRIYSSLWNADDWATRGGLVKTDWAQAPFTAYYRNYMAQSFSPSQFSDQKWQNQELDSNGRRRLRWVQKNFMIYNYCTDIKRFPQGFPPECRRF

SEQ ID NO: 888 - protein, 364 aa, Solanum lycopersicum
MTTSNTQQSYDKTSELKAFDDTKAGVKGLIDSGITKVPQIFIHPEALENKTTNPKNTHFIFPLIDLQNISINNKEIVKQIQEASETWGFFQVINHGIPVPVLDEMLRGARRFHDQDIDVKKPYYSRDIARKVMYNCNFDLFSEKSLAANWRDSLYSVMAPNPATPEEIPETCREITIEYSNYVMNLGYTLLELFSEGLGLKPNHLKEMGCAEGLGILCNYYPKCPQPEIAIGTSRHADNDFFTVLLQDDIGGLQVLHKNQWVDVPPTHGALVVNIGDILQLISNDKYKSVVHRVLANTIGPRISIASFFSTGPFSTSRIYGPIEELLSKDNPPKYRSTTMKDFFEYSNKKGLDGNSNLSHYKII

SEQ ID NO: 889 - protein, 159 aa, Solanum lycopersicum
MGLFNISLLLTCLMVLAIFHSCEAQNSPQDYLAVHNDARAQVGVGPMSWDANLASRAQNYANSRAGDCNLIHSGAGENLAKGGGDFTGRAAVQLWVSERPSYNYATNQCVGGKKCRHYTQVVWRNSVRLGCGRARCNNGWWFISCNYDPVGNWIGQRPY

SEQ ID NO: 890 - protein, 345 aa, Solanum lycopersicum; identical to SEQ ID NO: 742

SEQ ID NO: 891 - protein, 144 aa, Solanum lycopersicum
MASISGTMISTSFLPRKPAVTSLKAISNVGEALFGLKSGRNGRITCMASYKVKLITPEGPIEFECPDDVYILDQAEEEGHDLPYSCRAGSCSSCAGKVTAGSVDQSDGNFLDEDQEAAGFVLTCVAYPKGDVTIETHKEEELTA

SEQ ID NO: 892 - protein, 480 aa, Solanum lycopersicum
MVHVAGVFILVGIAVLAAVEGRNVLKLPSEASRFFDDADDSVGTRWAVLLAGSNGYWNYRHQADVCHAYQLLRKGGLKDENIIVFMYDDIAHHEENPRPGVIINSPAGEDVYEGVPKDYTGDDVNVHNFLAVLLGNKTALTGGSGKVVNSGPNDHIFIFYSDHGGPGVLGMPTNPYLYADDLIAVLKKKHAAGTYKSLVLYIEACESGSIFEGLLPNGLNIYATTASNAEESSWGTYCPGEYPSPPPEYETCLGDLYAVSWMEDSEMHNLRTENLRQQYHLVKKRTANGNTAYGSHVMQFGDLQLSMESLFRFMGTNPANDNYTYVDDNSLLASSKAVNQRDADLLHFWDKFRKAPEGSARKVEAQKQFTEAMSHRMHLDERIALVGKLLFGIQKGPEVLKHVRSAGQPLVDDWACLKSFVRTFESHCGSLSQYGMKHMRSIANICNAGIQMEQMVEASAQACPSIPSNIWSSLHRGFSA

SEQ ID NO: 893 - protein, 295 aa, Solanum lycopersicum
MNMKGVLVAFVLINLSILASCGAPRKVIDVPFWNNYEPSWSSHHIKYLNGGTTAELLLDKSSGTGFQSKRSYLFGHFSMKMKLVGGDSAGVVTAFYLSSTNAEHDEIDFEFLGNRTGQPYILQTNVFTGGKGDREQRIYLWFDPTKDFHSYSVLWNTYQIAIFVDDVPIRVFKNSKDIGVKFPFNQPMKIYSSLWNADDWATRGGLEKTNWSGAPFIASYTSFHIDGCEAVTPQEVQVCNTNGMKWWDQKAFQDLDGPEYRKLHRVRQNFTIYNYCTDRKRYPTLPLECTRDRDL

SEQ ID NO: 894 - DNA, 582 bp, Solanum lycopersicum
catgatgacaacacttgaaaagtatcaacaatgcagttacgcatctttggacccgatgttaccggttagtgatactcaggtattgtttatctactttatcatgtcgtaagtatattatttgtaaagatatatatcaagatagttcgattgcgtacacttacattttgattatgtttggtgaatactattctaatacctttttttttcctaaagcctaacaaataaagataattaagatgggaacgtaattcaagtacaacatggttccatacgtgacatatttacacatatagtggaaccaaaagagcaatttttcctaatatcattttctaaatatcacgtgtgcccgtgattcttttttatggacatgaattttttttttaatatgagtggaagtaaggttcgatctttctatctgctttgatatcatattgaatcgtgtgattgtctctttaaaaaattaagcaagagcatattttattaattaattgtctttctcgacgtttttctctttcaacagatgaactacaatgagtatgtgaggctaaaagctagagttgagctccttcaacgttctcaaag

SEQ ID NO: 895 - RNA, 36 nt, Artificial Sequence
  Description of Artificial Sequence: Synthetic oligonucleotide
guaucacuaaccgguaacauguuuuagagcuaugcu

SEQ ID NO: 896 - RNA, 36 nt, Artificial Sequence
  Description of Artificial Sequence: Synthetic oligonucleotide
ugaacuacaaugaguaugugguuuuagagcuaugcu

SEQ ID NO: 897 - DNA, 204 bp, Solanum lycopersicum
atggcttccaaaatgtgtgaaccccttgtgattggtagagtgattggtgaagttgttgattatttctgtccaagtgttaagatgtctgttgtttataacaacaacaaacatgtctataatggacatgaattctttccttcctcagtaacttctaaacctagggttgaagttcatggtggtgatctcagatccttcttcacactg

SEQ ID NO: 898 - RNA, 36 nt, Artificial Sequence
  Description of Artificial Sequence: Synthetic oligonucleotide
aucacucuaccaaucacaagguuuuagagcuaugcu

SEQ ID NO: 899 - RNA, 36 nt, Artificial Sequence
  Description of Artificial Sequence: Synthetic oligonucleotide
ccuaggguugaaguucauggguuuuagagcuaugcu

SEQ ID NO: 900 - DNA, 400 bp, Solanum lycopersicum
atggaaactcttctcaagccttttccatctcttttactttcctctcctacaccctataggtctattgtccaacaaaatccttcttttctaagtcccaccaccaaaaaaaaatcaagaaaatgtcttcttagaaacaaaagtagtaaacttttttgtagctttcttgatttagcacccacatcaaagccagagtctttagatgttaacatctcatgggttgatcctaattcgaatcgggctcaattcgacgtgatcattatcggagctggccctgctgggctcaggctagctgaacaagtttctaaatatggtattaaggtatgttgtgttgacccttcaccactctccatgtggccaaataattatggtgtttgggttgatgagtttgagaatttaggac

SEQ ID NO: 901 - RNA, 36 nt, Artificial Sequence
  Description of Artificial Sequence: Synthetic oligonucleotide
agaccuauaggguguaggagguuuuagagcuaugcu

SEQ ID NO: 902 - RNA, 36 nt, Artificial Sequence
  Description of Artificial Sequence: Synthetic oligonucleotide
acccuucaccacucuccaugguuuuagagcuaugcu

SEQ ID NO: 903 - DNA, 451 bp, Solanum lycopersicum
atgacaaaagaaaccataatcactgacgccatcacctacattagggagctacaaatgaatgtggacaacctaagtgagcagcttcttgaaatggaagcaactcagggggaggaactggagacaaaaaatgaagagattatcgatactgcagacgagatgggtaaatggggcatagaggtaggtaactttatgtataaaaccaaagtttcaatctttgatattcttgaattataaggacagtaaaacaactttgatctttgtttttctaaaacagcctgaagttcaagtggctaacattggcccaactaagctttggataaaaatagtctgccaaaagaaaagaggtggattaactaaactgatggaggcaatgaatgctcttggatttgatataaatgacaccagtgccactgcctctaaaggagctattcttattacttcatctgtggag

SEQ ID NO: 904 - RNA, 36 nt, Artificial Sequence
  Description of Artificial Sequence: Synthetic oligonucleotide
ugaaauggaagcaacucaggguuuuagagcuaugcu

SEQ ID NO: 905 - RNA, 36 nt, Artificial Sequence
  Description of Artificial Sequence: Synthetic oligonucleotide
uggauuaacuaaacugauggguuuuagagcuaugcu

SEQ ID NO: 906 - DNA, 508 bp, Solanum lycopersicum
atggctaaagaacggtctatggaggcaacccctacgtgggcaattgctgtggtttgcttcatcttgctcgctatttctatttttattgaacaaattattcatcacattggagaggtacctactatataatttcaaaatcttttactagatcgatatgaacaaaatatgcttattaattgttgggaaaaccattttcttttttagtggttactggaaaagcggaaaaagtctctatatgaagcacttgaaaagatcaaagctggtaaattcaaaatacagtcttgtattataaaataatatagtttaaagatggatcatactcatgacatttttggtgtgtgtgtgtcggacagaacttatgctgttgggattcttatcactgttgttgacagtgttgcaagatccagtttctaacttatgtgtccccaagagtgttggttattcatggcatccttgtatggcaaaggaagatgccaagtctgagtatgatgacccttgtctaccaaag

SEQ ID NO: 907 - RNA, 36 nt, Artificial Sequence
  Description of Artificial Sequence: Synthetic oligonucleotide
accacagcaauugcccacguguuuuagagcuaugcu

SEQ ID NO: 908 - RNA, 36 nt, Artificial Sequence
  Description of Artificial Sequence: Synthetic oligonucleotide
augaauaaccaacacucuugguuuuagagcuaugcu

SEQ ID NO: 909 - DNA, 835 bp, Solanum lycopersicum
atgtcactacccaaaaaaatatcccttttcctccaaattttcatcttttttgttttcaccattaatgcaaactctgatcttgaagcccttttgaagctcaaagaatccatggttgctcctggaacttctgcacttcttgattggaacaacaacacaaaaaattaccctttttcccattgttctttttctggtattacatgtaacaataactctcatgttatatctattaacatcactaatgttcctctatttggtactattccacctgaaattggtcttttacaaaatcttgaaaatcttactatttttggtgataatcttactggtacactccctttagaaatgtcacaactttcttctattaaacatgttaatctttcttacaacaatttttctggtccttttccaagagaaatcctgttggggttaataaagcttgaatcttttgacatttataacaacaatttcactggtgaacttcctattgaggttgtaaagttgaaaaatttggaaactttacatcttggtggaaactattttcatggtgaaataccagaagtttattcccatattgtaagtttaaagtggttgggtttagagggaaattcacttactgggaaaataccaaagagtttggctttgttaccaaatcttgaagaacttagattgggttactataatagttatgaagggggtattccatctgagtttggtaatattagtacacttaaacttcttgatcttggaaattgtaatcttgatggtgaagttcctccaagtcttggaaatttgaagaagttgcattctttgtttctacaagtgaacagacttacag

SEQ ID NO: 910 - RNA, 36 nt, Artificial Sequence
  Description of Artificial Sequence: Synthetic oligonucleotide
agaaguuccaggagcaaccaguuuuagagcuaugcu

SEQ ID NO: 911 - RNA, 36 nt, Artificial Sequence
  Description of Artificial Sequence: Synthetic oligonucleotide
uuacuauaauaguuaugaagguuuuagagcuaugcu

SEQ ID NO: 912 - DNA, 500 bp, Solanum lycopersicum
cataattagaaaaaaaatccattttaccctttaattaaatgatttatactgacaacttaaatatctcaaatttgtttttgaccctaaatttgaaaatatactttattttttctgaaactttctgacgtcaaatgatataaagcagtattattgatacgcccaaaggttctcaataaaccatgtcaaaaggagaaggccatagagataatatatctaattatcaattaggattaaacaaaacaagaataattaacaattaaacacaactattttatatagtggacattctttaagattccttataattaggatcctttgggatataccataaggttacattaaccatttggaatctccattggttaacttaaacccctaatttgtcaactcttttttacctatataaaccccacctaaatcaatttcataaaattaaaacacatccctaattactcactaatcttgtttaattatcattttaatcacttttttgttttttt

SEQ ID NO: 913 - DNA, 43 bp, Artificial Sequence; identical to SEQ ID NO: 185
  Description of Artificial Sequence: Synthetic oligonucleotide

SEQ ID NO: 914 - RNA, 36 nt, Artificial Sequence
  Description of Artificial Sequence: Synthetic oligonucleotide
aguauuauugauacgcccaaguuuuagagcuaugcu

SEQ ID NO: 915 - RNA, 36 nt, Artificial Sequence
  Description of Artificial Sequence: Synthetic oligonucleotide
aaccuuaugguauaucccaaguuuuagagcuaugcu

SEQ ID NO: 916 - RNA, 36 nt, Artificial Sequence
  Description of Artificial Sequence: Synthetic oligonucleotide
aaaaagaguugacaaauuagguuuuagagcuaugcu

SEQ ID NO: 917 - DNA, 600 bp, Solanum lycopersicum
ttttagtattgctgtaccaaggtcgaatcttattgttaacacatattttttacagagcacccacaaccttaaaataatgcaacgaccaaaattgtgattatgcctgatttagtattaatatgattcaaatgattacttcattcgtccacttttatttgccatacattttttaaaaattaatttgactaatttttaaagttaaattaaattacattaactcatattttaaacaaaagaattagatatccaaaaactatatgaaaagtactatagattacaattttttacatataatataaagaaaaaatgcatcttaaaatattagtcaaagttcttataacttaattataaaaatagaaattgtgacaaacaataattaaagaagaaagttcgaatttactctcaaactttataattccaatataatatacattaatttttattaaactaatatatgtaacttaagtaatatgtcgtgtaagtataagaaactctcccaaataggatttacatgtaaattcagattagttaaattttaatgtgaatatatatttcacgtgaaataataaatcaaaaaaacaaaaagaatgtcaacttttt

SEQ ID NO: 918 - DNA, 12 bp, Artificial Sequence
  Description of Artificial Sequence: Synthetic oligonucleotide
gtaagcgcttac

SEQ ID NO: 919 - RNA, 36 nt, Artificial Sequence
  Description of Artificial Sequence: Synthetic oligonucleotide
uuaacaauaagauucgaccuguuuuagagcuaugcu

SEQ ID NO: 920 - RNA, 36 nt, Artificial Sequence
  Description of Artificial Sequence: Synthetic oligonucleotide
aaauguauggcaaauaaaagguuuuagagcuaugcu

SEQ ID NO: 921 - RNA, 36 nt, Artificial Sequence
  Description of Artificial Sequence: Synthetic oligonucleotide
uauaagaaacucucccaaauguuuuagagcuaugcu

SEQ ID NO: 922 - DNA, 300 bp, Solanum lycopersicum
gatgcgactttgtttgattatactttttccaaaggagagaattaagagattatatttggaattacgcagacaaaatttgaaagacatcttataagtttgaaatccaattacaagtggaatttaaaattttcacgacttgtcaaccattgattctcaaataaagtgaaaaattattccaaaaacaaataaatattttttttatgaccaaatatgtcctcaagaacatatgaaagctctctagtcatgagtataaataacaagggctagctagctcttgtctactcataaaatatcatccat

SEQ ID NO: 923 - DNA, 16 bp, Artificial Sequence
  Description of Artificial Sequence: Synthetic oligonucleotide
gaatatatatatattc

SEQ ID NO: 924 - RNA, 36 nt, Artificial Sequence
  Description of Artificial Sequence: Synthetic oligonucleotide
uuugauuauacuuuuuccaaguuuuagagcuaugcu

SEQ ID NO: 925 - RNA, 36 nt, Artificial Sequence
  Description of Artificial Sequence: Synthetic oligonucleotide
guuugaaauccaauuacaagguuuuagagcuaugcu

SEQ ID NO: 926 - RNA, 36 nt, Artificial Sequence
  Description of Artificial Sequence: Synthetic oligonucleotide
gucaugaguauaaauaacaaguuuuagagcuaugcu

SEQ ID NO: 927 - DNA, 300 bp, Solanum lycopersicum
gcaggggataaggtctctcgccctcctcaaactctacttgaaaaattacactgatgtattgtcgttgttgttattgttaactcaaactaaacacaagataaatttaatctcattctttcttaaccaaagcctcttaactattttctttgagcaaagtaaaattgaaagaatcaaataaataactgagatgagctcatctttatgtattgcctcagcatgtagaggatttcagaactgcactgtcatatcataaaaagtatacttatgatatacaacaatggctgcatggctcatcatttt

SEQ ID NO: 928 - RNA, 36 nt, Artificial Sequence
  Description of Artificial Sequence: Synthetic oligonucleotide
uuucaaguagaguuugaggaguuuuagagcuaugcu

SEQ ID NO: 929 - RNA, 36 nt, Artificial Sequence
  Description of Artificial Sequence: Synthetic oligonucleotide
gcucaaagaaaauaguuaagguuuuagagcuaugcu

SEQ ID NO: 930 - RNA, 36 nt, Artificial Sequence
  Description of Artificial Sequence: Synthetic oligonucleotide
cugaaauccucuacaugcugguuuuagagcuaugcu

SEQ ID NO: 931 - RNA, 20 nt, Artificial Sequence
  Description of Artificial Sequence: Synthetic oligonucleotide
uugacagaagauagagagca

SEQ ID NO: 932 - DNA, 266 bp, Solanum lycopersicum
agaagcatcagcatcaatggcagccaaataacctactttctgaagcaacataaacaagatgtgggttaagcatgctctctatcttctgtcaattcccggatttctaagcaaattgttatttgtgaccttcaagtatctagctaatagtactttcatttcccttgtgtaaagggaaggacaaaaagaataagccgttggcactgtctgctagtattcgaaaaatgaaatatttgtagtatgaatgcatatccatgttgacattccaa

SEQ ID NO: 933 - RNA, 41 nt, Artificial Sequence
  Description of Artificial Sequence: Synthetic oligonucleotide
uaauuucuacucuuguagaucuuagaaauccgggaauugac

SEQ ID NO: 934 - DNA, 471 bp, Solanum lycopersicum
gtcgtttggttcatagggatgtcccggaagtaagtttagaattaaatttatactttgtttggttgagggtgagataaatctagacgttcaatcaaacagaatataaatttaatctcaaacttaatcctgaatatcccatccaatgccaatataatttagtcagcaaaccaaatgacgcgaaatcataagtagtaccactttcagtacttaattttttttttagattcgagttatagttctggggtgggaattaaactaggttgaaataagaaaaatggagacaccaattaccttgttgatttacccaaattacatgactgctccaatgttttgttactgtcaagtagtgttagcaattgggctggagaaatggactacgttggaataataataatttgtagcagtaatttcattgtttactgtatttacttcactgtatgagttattgaaggctatgataatatattaaaa

SEQ ID NO: 935 - DNA, 36 bp, Artificial Sequence; identical to SEQ ID NO: 199
  Description of Artificial Sequence: Synthetic oligonucleotide

SEQ ID NO: 936 - RNA, 36 nt, Artificial Sequence
  Description of Artificial Sequence: Synthetic oligonucleotide
uuugguucauagggauguccguuuuagagcuaugcu

SEQ ID NO: 937 - RNA, 36 nt, Artificial Sequence
  Description of Artificial Sequence: Synthetic oligonucleotide
aaaaaauuaaguacugaaagguuuuagagcuaugcu

SEQ ID NO: 938 - RNA, 36 nt, Artificial Sequence
  Description of Artificial Sequence: Synthetic oligonucleotide
guaauuuggguaaaucaacaguuuuagagcuaugcu

SEQ ID NO: 939 - DNA, 300 bp, Solanum lycopersicum
gatcttattataatttggtttcctagtgctacattagtattaagaacaatttcccatttggctgtattttgtttgtaatatgcaccaactgttgttttgatggtggccttgtggggcgatgaatattcgtatgacaaaataagaagggaaaaaataggttgtgaattaaggaaagtgtaggccattattagtactctatcaaatagaaagacggtttagtcttttttatggcaatgaaaacgatctgcaactcatatttctgtatctattcatttgttccgtccaccccctttctatcta

SEQ ID NO: 940 - RNA, 36 nt, Artificial Sequence
  Description of Artificial Sequence: Synthetic oligonucleotide
cuuaauacuaauguagcacuguuuuagagcuaugcu

SEQ ID NO: 941 - RNA, 36 nt, Artificial Sequence
  Description of Artificial Sequence: Synthetic oligonucleotide
cgaauauucaucgccccacaguuuuagagcuaugcu

SEQ ID NO: 942 - RNA, 36 nt, Artificial Sequence
  Description of Artificial Sequence: Synthetic oligonucleotide
uugugaauuaaggaaaguguguuuuagagcuaugcu

SEQ ID NO: 943 - DNA, 300 bp, Solanum lycopersicum
tcaactccatctactacaaaaaacaaaaaaacaatgatatttttagctaataataaccaccaatatctactacttctcttacaactttagtagtatctatagttatcttttttaatctactcttttacttctttactatattgtcttcctctcaatttatttgaattagtgacttgatatcaagtttcaataaagaaacaaagactgactttagaattttgtgatttacaataagttgtacatatttgtatgactatcttaaaaagttaaatcattattattaaatataaaaatatgatt

SEQ ID NO: 944 - RNA, 36 nt, Artificial Sequence
  Description of Artificial Sequence: Synthetic oligonucleotide
agagaaguaguagauauuggguuuuagagcuaugcu

SEQ ID NO: 945 - RNA, 36 nt, Artificial Sequence
  Description of Artificial Sequence: Synthetic oligonucleotide
acuaauucaaauaaauugagguuuuagagcuaugcu

SEQ ID NO: 946 - DNA, 300 bp, Solanum lycopersicum
atgggaaacaagcaattaagtggttgaaagtttgagattggaaactaagaaccaataaatgtaatttcttgcatacatacaagttgagttttttgtgtttcaaagactaactagcttgcatgtttagtaaactataatgatatatatataaatatgtcatgtaataagtcaaacatacatttctattttggaccatttctcgacttgtgcgtgatattcatactaatcttttttttatcgtttcaattttctatgatatcattgaagggggactacattatctattctacttcttgtttt

SEQ ID NO: 947 - RNA, 36 nt, Artificial Sequence
  Description of Artificial Sequence: Synthetic oligonucleotide
augggaaacaagcaauuaagguuuuagagcuaugcu

SEQ ID NO: 948 - RNA, 36 nt, Artificial Sequence
  Description of Artificial Sequence: Synthetic oligonucleotide
uuucuaugauaucauugaagguuuuagagcuaugcu

SEQ ID NO: 949 - DNA, 2718 bp, Capsicum chacoense
atggctcatgcaagtgtggcttctcttatgagaacaatagaatctctcttgacattcaattcgccgatgcaatctctatcctgtgatcacagagaagaactttgcgctcttcgtgaaaaagttagttccctggaagtatttgtcaagaactttgagaaaaacaatgtttttggggaaatgacggattttgaagtagaggtaagagaagttgcaagtgctgctgaatacacaattcaactgagactaacaggaactgtactgggagaaaataaaagccagaaaaaaaaggcgcgtcgaaggtttcgtcaaagcctgcaacaagtagcagaggacatggatcatatctggaaagagtcgacaaagatccaagataaaggaaaacaagtatcaaaggaatcattggttcatgatttttcaagttcaacaaacgatattttgaaggttaagaacaatatggttggacgtgatgatcaaaggaaacagttgttagaagatctgactagaagctactctggggaacccaaagtcatcccgattgtcgggatgggaggcataggtaaaacaaccttagcaaaagaagtttacaatgatgaatcaattctatgccgttttgatgttcatgcctgggctaccatatctcaacagcacaacaaaaaggaaattttgctgggccttctgcattccacaatcaaaatggatgacagggttaagatgattggtgaagcagagctagcagacatgttacagaaaagtttaaagagaaagaggtacttaattgtcttggatgatatctggagttgtgaagtgtgggatggcgtgagacgatgctttccaactgaagacaatgcagggagtcgaatactgttgactacccgtaatgatgaagtagcttgttatgctggtgtagagaatttttctttgcggatgagcttcatggatcaagatgagagttggagtcttttcaaaagtgcagcattttcaagtgaagcattaccatatgagttcgagactgttggaaagcaaatcgcagatgaatgtcacgggttaccactaactattgtcgtggttgcagggcttctcaaatctaaaaggacaatagaagattggaaaactgttgctaaagatgtcaagtcattcgtcacaaatgatcctgatgaacgatgttcacgtgtgcttgggttgagttacgatcacttgacaagcgatctaaaaacatgtcttctgcatttcggaatttttccagaagacagtgatattccagtgaagaatttgatgagatcatggatggctgaggggttcctgaagttggaaaatgatttggaaggagaggttgagaagtgtttgcaagagcttgtcgatagatgtctagtcctcgtcagcaagagaagtcgagatggaacaaaaattagatcatgtaaggttcatgatctaatatatgacctgtgcgtgagagaagttcaaagggagaacatttttatcatgaacgacattgttcttgacgtatcatatccagaatgttcatatctctgtatgtataaaatgcagccctttaagcgcgtgactggtgatgaaattaattattgtccctatggtctttatagggctcttcttacccctgtaaatcgtcagttgagagatcatgacaacaacaatcttttgaaacgaacccattctgttttctcttttcatcttgagcctttatattatgttctcaaatcagaggttgttcatttcaaattactcaaagtcttggagctgagacacagacagattgatggtttccctcgagagatactaagcctcatctggttgaggtacctatcattgttcagctatgggaatttcgatgtacctccagaaatttgcaggttatggaatctgcagacattcattgttcaacggtttcgatcagatataataatttttgctgaggaaatttgggaactaatgcaattaaggcatcttaaactgcccagattttatttgccagattgcccaagtggatctgttgacaaaggaaggcacttggatttttcaaacttacaaactatttcttacttgtctccacgttgttgcacgaaggaggttattatggggattcagaatgtcaaaaaattaggaatcagtggaaataaggatgactataaaagttttcgggactctgggcttcccaacaatcttgtctatctgcagcaacttgaaatattgagtcttatatctgttgattatagccttttgccagtgatcatttcaagtgcaaaagcttttccagcaacgctcaagaagttgaagttggaaagaacttatctaagctggtcatacttggacatcatagctgagttgcctaaccttgaggtgctgaagctgatggatgacgcttgttgtggtgaagaatggcatccaattgttatgggatttaatcgattgaagcttttgctaattaaatatagttttctcaagttctggaaagccacaaatgacaattttcctgtccttgagcgcctcatgattagaagttgcaaaaatttgaaagagatacccattgagtttgcagatatacacacactacagctgattgagttaagagagtgtcctcccaaacttggggaatctgctgcacgaattcagaaagaacaagaagacctcggaaacaaccctgtggatgttcgtatctcaaatccattgaaggagagtgattctgattcagaagaacattag

SEQ ID NO: 950 - RNA, 36 nt, Artificial Sequence
  Description of Artificial Sequence: Synthetic oligonucleotide
auuauaagccauagauuccaguuuuagagcuaugcu

SEQ ID NO: 951 - DNA, 4718 bp, Artificial Sequence
  Description of Artificial Sequence: Synthetic polynucleotide
tttaggccctgtttcgtcatagatttctcaagtaatatttggggggaaatttgacaaatattgtttgttcatacaatttgtcataatttggcaaatatttttgacaaatatcccaattttcaaatactaatatttcatagtatatgaatcaaatctcattatttgggatcttttaaaaattaaaaatttacactaaacttttatcttttacaaaaataccccctgtagtaattgtttgtgttgtattacataattttttacgtaaacaccaaaatagtgatgaaatatttagtgaatatgaaagtgatgaaatggggttattgataaaaataatgaacaattggctcagggtaataaagttgtgtgttttgtctacttcactgtgtatggaatgatacttgtttgactcactccaaaactatcacaattctcatggatactacttgttatttgttgcaacgaagattcaattgacttaatacaaacttatggttagttgttatagttttttaaatttatgttatatttttataaaaaaataaaatatattttccaaatactatggctaaacacaaagagaaatttcacacaaattttcactcatatctaattattttctatccgtgttaaatctcatttacttaataaaaaatcattaaaaaatatattattctatttaaaaatttgttttatctaagaataattttagaagaagccgtatactagttatataaattcatcttaatttcttgtttagctaaataagagaaaattcaaatgatatttttctaataatattaaataggtgcggtgatatgacacatggggataactagccctgtgtacctctctatataatatgaactttctcagaaggatgaataagaatattgtgagcaaatcttctttcatttgtaattcaaaaattattactccttctttacttttccaatttaattatatttatatgcaactccatatatattataagccatagattatggctcatgcaagtgtggcttctcttatgagaacaatagaatctctcttgacattcaattcgccgatgcaatctctatcctgtgatcacagagaagaactttgcgctcttcgtgaaaaagttagttccctggaagtatttgtcaagaactttgagaaaaacaatgtttttggggaaatgacggattttgaagtagaggtaagagaagttgcaagtgctgctgaatacacaattcaactgagactaacaggaactgtactgggagaaaataaaagccagaaaaaaaaggcgcgtcgaaggtttcgtcaaagcctgcaacaagtagcagaggacatggatcatatctggaaagagtcgacaaagatccaagataaaggaaaacaagtatcaaaggaatcattggttcatgatttttcaagttcaacaaacgatattttgaaggttaagaacaatatggttggacgtgatgatcaaaggaaacagttgttagaagatctgactagaagctactctggggaacccaaagtcatcccgattgtcgggatgggaggcataggtaaaacaaccttagcaaaagaagtttacaatgatgaatcaattctatgccgttttgatgttcatgcctgggctaccatatctcaacagcacaacaaaaaggaaattttgctgggccttctgcattccacaatcaaaatggatgacagggttaagatgattggtgaagcagagctagcagacatgttacagaaaagtttaaagagaaagaggtacttaattgtcttggatgatatctggagttgtgaagtgtgggatggcgtgagacgatgctttccaactgaagacaatgcagggagtcgaatactgttgactacccgtaatgatgaagtagcttgttatgctggtgtagagaatttttctttgcggatgagcttcatggatcaagatgagagttggagtcttttcaaaagtgcagcattttcaagtgaagcattaccatatgagttcgagactgttggaaagcaaatcgcagatgaatgtcacgggttaccactaactattgtcgtggttgcagggcttctcaaatctaaaaggacaatagaagattggaaaactgttgctaaagatgtcaagtcattcgtcacaaatgatcctgatgaacgatgttcacgtgtgcttgggttgagttacgatcacttgacaagcgatctaaaaacatgtcttctgcatttcggaatttttccagaagacagtgatattccagtgaagaatttgatgagatcatggatggctgaggggttcctgaagttggaaaatgatttggaaggagaggttgagaagtgtttgcaagagcttgtcgatagatgtctagtcctcgtcagcaagagaagtcgagatggaacaaaaattagatcatgtaaggttcatgatctaatatatgacctgtgcgtgagagaagttcaaagggagaacatttttatcatgaacgacattgttcttgacgtatcatatccagaatgttcatatctctgtatgtataaaatgcagccctttaagcgcgtgactggtgatgaaattaattattgtccctatggtctttatagggctcttcttacccctgtaaatcgtcagttgagagatcatgacaacaacaatcttttgaaacgaacccattctgttttctcttttcatcttgagcctttatattatgttctcaaatcagaggttgttcatttcaaattactcaaagtcttggagctgagacacagacagattgatggtttccctcgagagatactaagcctcatctggttgaggtacctatcattgttcagctatgggaatttcgatgtacctccagaaatttgcaggttatggaatctgcagacattcattgttcaacggtttcgatcagatataataatttttgctgaggaaatttgggaactaatgcaattaaggcatcttaaactgcccagattttatttgccagattgcccaagtggatctgttgacaaaggaaggcacttggatttttcaaacttacaaactatttcttacttgtctccacgttgttgcacgaaggaggttattatggggattcagaatgtcaaaaaattaggaatcagtggaaataaggatgactataaaagttttcgggactctgggcttcccaacaatcttgtctatctgcagcaacttgaaatattgagtcttatatctgttgattatagccttttgccagtgatcatttcaagtgcaaaagcttttccagcaacgctcaagaagttgaagttggaaagaacttatctaagctggtcatacttggacatcatagctgagttgcctaaccttgaggtgctgaagctgatggatgacgcttgttgtggtgaagaatggcatccaattgttatgggatttaatcgattgaagcttttgctaattaaatatagttttctcaagttctggaaagccacaaatgacaattttcctgtccttgagcgcctcatgattagaagttgcaaaaatttgaaagagatacccattgagtttgcagatatacacacactacagctgattgagttaagagagtgtcctcccaaacttggggaatctgctgcacgaattcagaaagaacaagaagacctcggaaacaaccctgtggatgttcgtatctcaaatccattgaaggagagtgattctgattcagaagaacattagccatggaaaccaaagttatttctagcggaatcaaccactctactcttcctcaaagttacatccgacccgaatccgatagaccacgtctatcggaagtggtcgattgtgaaaatgttccaataattgacttaagttgcggagatcaagctcaaataattcgtcaaattggagaagcttgtcaaacttatggtttctttcaggttcttatcgttggattcatgaattaataaatatttttcgattattaacgataaaaataataatcgactttactactttttaggtaattaatcatggtgtaccaaaggaagttgtagagaaaatgctaggggtagctggggaatttttcaatttaccagtagaagagaaactaaaattatattcagatgatccttcaaagaccatgagattatcaacaagttttaatgttaaaaaggagacagttcataattggagagattatctcagacttcattgttatcctctagagaagtatgctcctgaatggccttctaatccatcatctttcaggtaaacaccattaattaactgtttaactactttctttatgttaatatacattgctatctgagtcatacttcaattattattatcattatatacgtcaaccactttgtctgtatagtaatgcatggattggaagtaacctcaaataatatatcgtatgagatgttgtcaagtatctaagttgtttacgcgtataagagaaatacgaggctcaaactgagaagtgttgcatcctttaaaataagtgcatgtacatcacatatattaaaaaatagaacatgtgtcagatgcgtgtcagatgtttgtcaatattatagaatgtaaatatcctcaataaaatttcgttaaagaactacctaatatatatatatatatataaaaataaatagttcttaattaggtaataatttatttctttctaagaagagtcaactcattcaaaatatatatttataaaaacataaaaataaaa

SEQ ID NO: 952 - DNA, 300 bp, Solanum lycopersicum
atattccgaataacaattcaattgatggttggaagggattgagaatcgactatggtaatttctatgcatcgaagacattctatgatcctagcagaaatcgaagggttatttggggttggtcaaatgaatccgatgtattacctgacgatgaaattaagaaaggatgggctggaattcaaggtattccgcgacaagtatggctaaaccttagtggtaaacaattacttcaatggcctattgaagaattagaaaccctaaggaagcaaaaggtccaattgaacaacaagaagttgagcaagg

SEQ ID NO: 953 - RNA, 36 nt, Artificial Sequence
  Description of Artificial Sequence: Synthetic oligonucleotide
agguuuagccauacuugucgguuuuagagcuaugcu

SEQ ID NO: 954 - DNA, 253 bp, Artificial Sequence
  Description of Artificial Sequence: Synthetic polynucleotide
atggtaatttctatgcatcgaagacattctatgatcctagcagaaatcgaagggttatttggggttggtcaaatgaatccgatgtattacctgacgatgatattaagaaaggatgggctggaattcaaggtattccgcgacaagtatggctagaccttagtggtaaacaattacttcaatggcctattgaagaattagaaaccctaaggaagcaaaaggtccaattgaacaacaagaagttgagcaagggaga

SEQ ID NO: 955 - DNA, 201 bp, Solanum lycopersicum
ggatttagtatcattggcggagaacaccggttgaggaattaccgttcagttacgacggtgcatggattcgaacgcgacggagagatctggacggttgttttggaatcgtatgttgtagatgtaccggaagggaatacggaggaagatacacgccttttcgctgatacagttgtgaaattgaaccttcagaaattagcttct

SEQ ID NO: 956 - protein, 67 aa, Solanum lycopersicum
GFSIIGGEHRLRNYRSVTTVHGFERDGEIWTVVLESYVVDVPEGNTEEDTRLFADTVVKLNLQKLAS

SEQ ID NO: 957 - RNA, 36 nt, Artificial Sequence
  Description of Artificial Sequence: Synthetic oligonucleotide
acgcgacggagagaucuggaguuuuagagcuaugcu

SEQ ID NO: 958 - DNA, 202 bp, Artificial Sequence
  Description of Artificial Sequence: Synthetic polynucleotide
atttagtatcattggcggagaacaccggttgaggaattaccgttcagttacgacggtgcatggattcgaacgcgacggagagatctggacggttgttttgctatcgtatgttgtagatgtaccggaagggaatacggaggaagatacacgccttttcgctgatacagttgtgaaattgaaccttcagaaattagcttctgtt

SEQ ID NO: 959 - DNA, 300 bp, Solanum lycopersicum
ttttagtttccttcatttaagcaaaatatcttgaaatgtgtttttgtagtaataaaaatgaccctcgagtcaatccaatacttcctttctttggccaaaacattcaaatctacaaagagcaattacttctcttccaccgttttctattcaaatcctacaattacattatcttgactttcaaaaaaaaaaaagtttctttaccccacccccctaaacccccctaccccacttacttttctcccctatttattccttgctgcaacaaccccttaattctcattagaataatccacacctttc

SEQ ID NO: 960 - RNA, 36 nt, Artificial Sequence
  Description of Artificial Sequence: Synthetic oligonucleotide
aggauuugaauagaaaacggguuuuagagcuaugcu

SEQ ID NO: 961 - RNA, 36 nt, Artificial Sequence
  Description of Artificial Sequence: Synthetic oligonucleotide
uugcagcaaggaauaaauagguuuuagagcuaugcu

SEQ ID NO: 962 - DNA, 292 bp, Solanum lycopersicum
tctgataattcgaacaagctaatccatgtttggttaaacagttatacagtaataatgtattgcatgtattatcatccttttttgttttgttgcaaattttatttcgaaactctcttcaggaattatggcggcgatcgattaatcgaggacagtaaatgtaatgtatgcataagttgctactttaacatttgaaacctcctgaccatgcatttctgattgtatcacaatgtgtaattaaatggaattgttgtattttttgtatcattgaatcatatgcttatcttgtactata

SEQ ID NO: 963 - RNA, 36 nt, Artificial Sequence
  Description of Artificial Sequence: Synthetic oligonucleotide
uauaacuguuuaaccaaacaguuuuagagcuaugcu

SEQ ID NO: 964 - RNA, 36 nt, Artificial Sequence
  Description of Artificial Sequence: Synthetic oligonucleotide
acucucuucaggaauuauggguuuuagagcuaugcu

SEQ ID NO: 965 - RNA, 36 nt, Artificial Sequence
  Description of Artificial Sequence: Synthetic oligonucleotide
gugauacaaucagaaaugcaguuuuagagcuaugcu

SEQ ID NO: 966 - DNA, 367 bp, Solanum lycopersicum
ataagtatgtgcgtaaaagtctaagtggagtcacgtgtgtatgatatgaggtcacattagaattgttactagaaaagatatgaaggaatcttttcatttttattttattttctttttacatagagtaaacaaaaaaaattgactggaattgaagtggtaagccaaaaaatgtgagaatacatgaaaaagtgtgagagaagtcacgtgtgtatggtatgaggtcacatgaatattattgccgaaaatgatatgagagaatcttttcatttttattttattttcttttttaaacagagtaaaaaaaattaagtgtgtatatatatatatgagaaatggggaaacaaattatcaaacataattaccattg

SEQ ID NO: 967 - RNA, 36 nt, Artificial Sequence
  Description of Artificial Sequence: Synthetic oligonucleotide
agucacguguguaugauaugguuuuagagcuaugcu

SEQ ID NO: 968 - RNA, 36 nt, Artificial Sequence
  Description of Artificial Sequence: Synthetic oligonucleotide
agucacguguguaugguaugguuuuagagcuaugcu

SEQ ID NO: 969 - RNA, 36 nt, Artificial Sequence
  Description of Artificial Sequence: Synthetic oligonucleotide
auauauauauaugagaaaugguuuuagagcuaugcu

SEQ ID NO: 970 - DNA, 464 bp, Solanum lycopersicum
attacataaagatacaactataatctgacctagcttataaaggatgtgaaatctaaaatgatgatatataccttgataaaaaaattttgctacatcgccttttgcaattatttcattttgaaagtattcatatttgtttataaaaaattttcaaatattttaataaataaataaataaaattatattttatttatgattttcaaatatgtcaatgatataaatgattagctataaatctcataaatttctatatagacttattaaaataaagtataaaaagattttattttatttttgaaatacgaaaaatatgcgtgcttgagcctctaactacctcctatataaatgatgaaagaaaatgttaggtgtgagaagtatatatccttatcccaactttggaatttcaaatcgtttgattattaagttatttgtttgttgtggaaattaaatatgattcaaaggg

SEQ ID NO: 971 - RNA, 36 nt, Artificial Sequence
  Description of Artificial Sequence: Synthetic oligonucleotide
uuuauauaggagguaguuagguuuuagagcuaugcu

SEQ ID NO: 972 - RNA, 36 nt, Artificial Sequence
  Description of Artificial Sequence: Synthetic oligonucleotide
caaaaugaaauaauugcaaaguuuuagagcuaugcu

SEQ ID NO: 973 - RNA, 36 nt, Artificial Sequence
  Description of Artificial Sequence: Synthetic oligonucleotide
aaaugaugaaagaaaauguuguuuuagagcuaugcu

SEQ ID NO: 974 - DNA, 376 bp, Solanum lycopersicum
caaccctttaatgtcacatttcttgtttggtcttgtgaatttaagtctgcaactgtcacaaaaatcatactactatattaatgtgttgcatttatcgccatttttttaatactgttttcttgcttagcaaatattactatacttgggcggattctccaaatcccatgtgcaattaaaattacaaactttgttatttactccattttcttggatctctctatgacttgtctttttctaattttctatatatttaccaacatgttatgttgaattaaaagaagaaaaaaaacaagaagatttagttttttttatttttgtgtgtgtgtgtttgagaaaatgagtagtattacttattctaatttgatattgaagagga

SEQ ID NO: 975 - RNA, 36 nt, Artificial Sequence
  Description of Artificial Sequence: Synthetic oligonucleotide
uuuguaauuuuaauugcacaguuuuagagcuaugcu

SEQ ID NO: 976 - RNA, 36 nt, Artificial Sequence
  Description of Artificial Sequence: Synthetic oligonucleotide
uuuaauucaacauaacauguguuuuagagcuaugcu

SEQ ID NO: 977 - RNA, 36 nt, Artificial Sequence
  Description of Artificial Sequence: Synthetic oligonucleotide
agaaaacaguauuaaaaaaaguuuuagagcuaugcu

SEQ ID NO: 978 - DNA, 40 bp, Artificial Sequence
  Description of Artificial Sequence: Synthetic oligonucleotide
gccacgtgccgccacgtgccgccacgtgccgccacgtgcc

SEQ ID NO: 979 - DNA, 44 bp, Artificial Sequence
  Description of Artificial Sequence: Synthetic oligonucleotide
aaaatatttataaaatatttataaaatatttataaaatatttat

SEQ ID NO: 980 - DNA, 5042 bp, Solanum lycopersicum
atatataatattgtaatattaagtctataaaaaaattctttcattatattgaacatgtatacgaactttaaataatctagtatatatatataactatacgttggcaagtggaaacatttggtcctcacaatttcctcctccaagctgtggttctaagttctggatattcccacaatcgttggaccttccacatgtcactagacacgtgtcatcatttttctagtctagtttttgccttattttgttctagtcagtgagcaaatactctcttcgtttaaaaaaatgactttattttttttaatatgtttcaaaaaaaaaattatttgttttttttgcaacaatttaattttaactttctacgtgatatgtttaagaccgcaaaattaaaaagtattttggtacattatatataattttaatttagaaccaaaagattaaaaaatcttctttcttttcttaaattccgttccaaatcaaaatagaccattctttttaaaacggatggagtatttctacataaaattcattacattatttttaccatgtgtttaatgcccatttttgttagaatgtgattacgtgccttcatttttaatttgaatttacctttcgtattatctttattttgtcagaaactttaagatatatgtgagttaaattaggtttaatttatgggaatttcacaataatctcattagtgttgaagagctaattacatcatatctctattttttaaaaattataaaaatcctttaaatttgatggaatctggatactttctaaaacatctcgatacattgtgttttcgattttgtatacatccctcaacgtctcgattcattacattttggtttttgatacatcacacaaagtgttttatccgatcgatatattgcgtaaagtgataagaaagcgtaatgatttttctagtttttttaaatgatagaaaatatcagaaatatagtaaaataagttgtgtagttagataactttttcttaatttattctagatatattgtattcaagcatgatccgtatgtatatgagatacactgatgtgtctttgacctctctccaactctcaattgtcatgtatctatatttaagaataaaaatcctatatcacatatacacgtatcgagtatcaaaatttataagttgattctctcactcgcctctctctctatgtatttatatttcataatgtatttagtatcaaagatacatatatctagtatctttatatatgcatgtatctgacttgaaatctatttcgatactattaattaataagacgatatgtaattattagagtggattaatatttatgtaattaaggtgtgtgctaatctatgttgacatgctatgaggaccaaggaccaacattttttcttcaccaaacgcataaagtacataggtagacgtggttgctctatagactctcactttctatccacgatcagtgatgataatacaaaaatccctagccttaaaattaatggacaccattcattttctatataataccaccatatcttataagaaattaatttaagtgaaattctcgtacatcttcttcatttattttttttcaatcaaaaaactcaaaggggaattttgaagttgttgagaataagcaaatggctcaaacaatgttgttaacagccaatgccaaagttgatttaaggagtaaagaatctttagttgaaagactaaaaccaaagcctttgtcttctttgttcctaccttctcttcctttgagattttcttcttcttccactaatgcttcttcttcaaaattcactagtactactgttgctctattcaagtcaaaagctaaagctcctcccaaaaaggtaatactctctcgctctgtttcaatttatttaatgtagttttttgactggacatgtacgtgttttaaaattatcaaataagtgcgactcaaacatgaataaaatgttgatagtgttagttaaatatcgacaggttgcaccaccaaaggaaaagcaaaaggtggaggatgggatttttggtacctccggaggaattggcttcactaagcaaaatgagctatttgttggccgtgttgctatgattggttttgctgtgagtattactacacttcaatatattttttcttgatatcagatacattatgaaatacaaataaatagcgaaacaaattgaatcacattccaaggtcaataatgtattagataatgcggcatagggagattattagtgattgtctttatctactattatttgtcatgttgtgtttcttcaaaagtttatttgactagtttttaaatttaaattaaattatattaatttgatattttaacaaaaatttagatattcaaaaactctgtgaaaagtagtataaattgcaatttcttacgaatcatgatgaaaaaatacatcataaaatattagtcaaaatttttataatttaactacaaaaatagaaatcatgacaattaagaatgaacaaaaaatagtacgtgaccaaaggaaatcaataatttttatgtaaatactctgttcatattagaaaatttagtaaatatttaattaaaaccataaataaatatacctaagcttcttgcatgattaataattttatcagttatgtgaatgatgatgttaattttgatatataggcctctttgttgggagaagcaataacaggaaaaggtattttggcacaattaaatcttgaaactggaattccaatctatgaagcagagccacttctattgttcttcattctattcaatcttcttggagccattggagctttgggagacagaggcaaatttgttgatgaccctacccctcctactggccttgaaaaggctgttatccctcctggcaaatccttcaaatctgctttgggactcagtgaaggaggtattataactttataagctcactgcaataaaaataacttttagcggtattaaatattgacattaataaagaatgttaaagtctttatcgatattagttaagtgtcattagaatcaatgtcgctaaagactttagagacatatacaaagagtgttaatattgaatgtagtgattgacggtataaaagaaaaaacatattatgttgtgacgttgtttgattggatactgagctaaaaataattgcaggtccattgtttggattcacaaaggcaaatgagttgtttgtagggagattggcacaattgggaattgcattttccattataggtgaaattattacagggaaaggagcattggcacaattgaactttgagacaggtgtcccaatcaatgagattgagcctcttttgttgtttaacattgccttcttcttctttgctgctataaatcctggtactggcaaatttatcactgatgaggaagaagattagatatagagtactactactttttgtgtgtattacttatgtgtagttcttctaataagaattcaaacttcctttaaattcattcaaagttgtttgcactctccttcatcattttctatttaattcatttctgcgtttaccttactcgcaatttaagccctaaaataaagtcctttatgagaagacataaaaatttgagcaaattacacatcacatatttttaagataaaattataatttattctttaaaaatttatatttacgaaaattcttcaaagcggataaattaatataagcgttgatacatttatctaatgcgcgagatacaataatctgatgtgtgaggtacattttatatatgatacattaatctgatgtatgagatacactaatatgatgaacgagatacattaatgtaatgtgtgacatatgttaaagtcatgcgctatagtgagagattttaaaaatttgtaaaatttattagggataatagtaataaataaaatttcaagttggtttcgaggtattgcatatttggagtttatatattaatcacgtagaattaattgtcttttgctctttgtatctcatatgtgaggtaagcaaaatgcaccagtccattatcgcctgatcgatacataatattgtttttttaaaaggaaaaatcgtatcaagtgtaaattattaatttaaagttagtgttatagtcacaatttcacttaattttaattcgtagcaaatgctttgtcatcgtctctctccaaatttctcactcgccctctcctgatctcgctcggcagtctctcgcttgcctctttatacaaaaacacaaatgcatatattatgtttgtgtttgtataaagcgagagaaaactgtatatttatatatatatttttttttcgctcgccactctccctcgcctttctcattgatacaaatacaaatgtataaattgcgtttgtgtttttattaaacgagaaaaatctatatatgcaaatacaaacatatattttcaccctataaacttataattataaaaacacaaattttcccctataagttatcttttgtctttctctctttctcgttttatacaaacacaacacagattatacaaattacaatgaattttgtgtcatataaacgagagatatttcatatacaaatgttttatttcgattgaattttatacaaattcaaattttatgtagatatataattgaattgagagactgctatcgatctatacaaatacttcataaagcgcaattatacaaactatatctatattatacaaatataattttaatatttactaaatctaaaatttactctttttaaaaaataattaagttaattgtagcgaagtagatagctttgttaaaagttaaaactgtccattttttttaaaaaaacagtgccgaatacaagacataattaattaagatttaattaattaatgcatttcaactgagcgcgggaaatctaaacggaatgccgaataaaatcgcgggaaatagcaaccacaggtaacctgttaccggctataccggttctctaatcctttgttttcatataaccaagtgggccccacaacctagcaacaaaaggtaaaataggaaaaaggaaaaaagaat

SEQ ID NO: 981 - DNA, 9236 bp, Solanum lycopersicum
atttaggggtgccaaatgcgcgggttgagttaaaattataaatattaaaatgggtttaatagaaatcgagttgggtcttgacccacccaagtttactttgggcttaaatgggttgggctcaaatgggctaaaaatcgggttgggtcttgacccaccctatttgacccgattaatatcaataatttaacatattgatatttaatttatttaatcacaatttgaattcccactcaagaattttttgttaaaaaggtaaaaattgatagataaaaaaagatgctaaatagataataattcatacatttaatataggaacatatcttaataaaaagttttaaaacgggttgaaattggaaattaaattgggctcaattgagaattcttttcaaatgggttaagcttaatgagttgagaatgaacacaattcaaattatcttgagtccaatccttaaaattctgaacggattaaacaggttacctatgtttggattcatttttgacactcgtagttcaatttttcttttgaccttttaattcttcttttcttttatattttcttttgtggggaagcttaattaactatctttaatattttcttttgtggggaagcttaattaactagaaaaatattgttcttctatatttatttgtttaatttctgtcttatcacttgtctatttttattcatgtttcttgttagattataattagttattagtctttttacttgttgtgtattaaaaatattttcatattacatatctcttattacttgtctttctttttttaattaattatataaattagatattatttgacacgtttaactcccacgtaattttataaaatttgatcaaaatttacatttctagacttcgaaaaaatgtctagtactttttttttgaggtaatttaaattcttatccaatctttggttctacaaacctttaaaataatttatttataattaacgtataataatactctaacacgtctttaattctctaggtggcaattgttctcacttttaaaaggaattatcacgtcattgcagtctcattttgggaaaatggagcgtgatgaaaatattacattcttggggttaaaagaacatctccaaatccgctttatttattttacgctttattatttatatttaaaagataaagtaataaatagagtctcgaatcacgtctttaaagttctctactctctattacacttttttattagtttaataatatttttagtacttgtaattgacacattttttttttatataagattatggaaaaagggtttgatatacccctcaattttgtcatttgaagctgatatacccctcgttacaaaagtggctcatatatgtccttaccgttatacaaacggctcacatatacccctgccgttataaaatggctcacatatatccttcatttaacggaagttaaaaaattagttttaaatttatatttattacttctaatttttttttaaaaattatttaggggtatatatgatttttctatcaaagtacaaggtatattttaatttttttcatacataaattattttttgacttcttttattataattatttgaatttcttatttttattttgttttttcttttattccttaatttaaagaataaaaaattaaactatttttttgtgtgtattgtaatttaatttcgtattcgaagaaaaattttggtcatctacaataagttttacaagaatattagtgaaacataaataaatttgataatataattataaattagtcattgaaacaaaaaaaaaagtcaaaaatatatatttgacgaggattaaatttactcatatggattatattttttagaaaaaaaagtaataaaaatttaaattaaaattattattttttttcatttccgttagaggaaaagggtatatgtgagccatttgtttacaagtgggagtatatatgcgccactttcataacaaggcagttctaaatgacaaagttgagtggtatatcagacacttttccctaagattattaataaaattttctaatattcataattctttttaaatgtaatacaatatatacttttaaaaatatattatttcatataaactatttttatcccgaattaacaatattttattttattttcaattttcatcaatttaagagataatttggtattgttattgatttcaattatgaagaattcataaatttaaataataagatgaaaatttttaatttaaaatacaatacatgacatagtaatttaaatacacgatacaatacaatacataacataataattgaaaaactcacggttggccgttttcaaatataacaatatttgaaaaaaattagtgtataatttagagaattgttgtgcttgtgattacggttgtggttgttaattttttttcaattattcaagtttatttttaaaattttagaataaaatataattttatattaaataaagaatttgaaaagtaattattttatatttcatgagaattgtatagagtgattattttgaaaaacaaattatattatgaaataagaacatgaaatagaaataaaaataaaaataataatatgatattgaaaagaaaaaagaaaatttatttttaaaaagtataataaagaattagattggaattgattatgggaaaaaaaaaaaactctatactcaaaagaataaaatagaatgtatgataggagatgttttcggggatcaaaaatgtcaaatatttgcatagataggggattatttttgctaagtggtaaacattaaggaccatagttgtccaagcccctatgcattcgatcattttttttgggcaattgccaaaaccatccaaaaggagaagaaaatgaaaaaagagaggaagtgcagaaacaagaaaatgtggtgacgttgctaagctaattatcacaaaatgtcttatcccccttcatccatttccccttcactcaactctttcacacttaaaacacccaaaaattcagaagaagaaaaaaaaagatgcaaaatccacaacaactctttatactcaacgttcaatcttcatagcactctatttacatgaggtcagttattgggatttatatttatattcacatactcatcttttactctttgagtatattatgattctgcatttgacaatttaacttgtcaattttagctttgtaaatgtgctgctccgtctcaatttatgtgatacaagtcatacaaatgatcccttttacttaaaatttatgctaactcaaatggtgtcacactaattgggacggaaggagtagtatttaatgttaaactgaaggtgaatagagaggaacatgaaagggtgagttcttgattgattgtgaactatgcaccaaaacctttagttggaactgaagatgaatgtgggaagttgaaaatttatctgcatttcaatatttgaccttaaatcctacttatgtatcatagaatttcaatcaactagtgaatgtggaaaaattcttgattgtgaatctgatagtaagatttgatatgtgctgacgtgcaacacacacgcacacacgtagaatatgcatcttggaccaatcagtctgatatgtgcgcgtgtgtgttgcacagagtagatatcaatcagaaagatttagaagatagcacaatctgatatacttcatttctataggttggagttggtggtcattcaattgaataatggcgcttgcccctcattcaaacattctgtgcaatcatgaggccatcaaatgtcaagttggatcaaggcttcagagtcatacaagatttagctggggtagagcagattactttggtagtatagtcctagtgaaaatttgttccagaagacagatacctacatacttgcagaaatcttctagaatatgttgtggtttggattctagaagtctgcaactatcatcacgggggaaacaaaatctttcttctgcacatagaattaaccagaatgtacctaaggtgagtttgatattattttgttctgttgcttctcgtttactactttccgaaggaatgtgggggtctagctctgtcctctgcatccttttcatcctcttctttctctttgctgacagaagtcctctatatagggaaatacaatatggaaatttccagaagatgtagctttgatggtcttgaagaaatggggccaattggccaaaacagcaattgtaactatatttattttgtcagttgcttcaaaggctgatgccgttgatgctctcaaaacttgtacttgcttactgaaagagtgcaggtaatttgcagatgttactaaagtatgccggtatacttccttctaccgagctgccaatatattttgttttgctacccttcttatgtttctttcaagagctttgagcttgtttacttctattacatataaaaatacacaaggaatgtgaaattggttcttgtttgtacactgtggattgtcgtcctgaattaataattgagtgcagtggtaaggatgtcaaattcagttttcacggacatagactgtctctagctttttatgatcaactgtccataagttctcgattctagtcgtaattatcgataaaatcaagttttaagcatgttcaaagtgaaacataaccccaaccgtaatgcttttccatctattcctttccgattttgagactgttaagactttctgtgttctaattaggccatgagaatagcagtatgaatttgacttatttggagcaagtttttttagacctttacggtggtaaaagcaactgatactgttgctgtgctagggatgcaggaaagtttttactattattccaatttccctgaatctcaaaagatatctttttgtctcgtgccacaatttgatgaacttgtaaagatatagccacacaaatgtcttaggtttattttagaccacaaaattcacaagtctttttttctttcttaaagtttttgctaagtcaaactgtccaacaaaaattaggacggagggagtagtattgatgagtttcaacctccatccctaacatgcatgtctgatactcttaggtgacttattaaagtattatgctttcaggatagagcttgcgaagtgcatctcaaaccctgcatgtgcagctaatgttgcctgtctccaaacatgcaacaatagacctgatgaaacggaatgtcaggtgtctacaaacatcttattaaaactgaatattgatttgatcacatttatggaatattaatatgttggaatatgggtgcagataaaatgtggtgatttgtttgaaaacagtgttgtagacgagttcaatgagtgtgcagtctcccggaagaaatgtgtacctcgtaaatctgatgttggtgactttcctgtgcctgatcccagtgttctcgtccaaaagtttgacatgaatgattttattggaaaatggtacatcactcgcggtttgaatcccacatttgatgtttttgattgtcaattgcatgagttccatacagaaggaaacaaacttgtgggaagtctgacttggagaatagggacacctgatggaggatttttcactcgatccgcagtgcaaaaattcgtgcaagatccaaagtatcccgggatactctacaatcatgataatgagtatcttcactaccaagatgactggtatctcacttcctacagtctccatattgtttgtacttgcattgtgattcacctaaacacgttaattgattttctctgcaggtatattttgtcatccaaagttgaaaacagtccagatgattacatatttgtgtactataagggcagaaatgatgcatgggatggatatggtggttctgtactttatactagaagctccgttttgcctgaaacgattatacctgagttgcaaattgcagctcaaaaagttggtcgtgatttcaacactttcataaaaacagacaatacttgtggccctgagccaccccttgttgaacggttagagaagaaagtggaagaaggagagcggacaatcataaaagaagtcgaggaaatagaagaagaagtcgagaaggtgaaggaaaaagaagtcagcttattcagtagactgttcgaaggtttcaaagagctgcaacaagatgaagaaaactttataagagagctcagcaaagaagaaatggatattttggatggacttaaaatggaagcaactgaagtagaaaaactctttggaaatgcattaccaataaggaaattaaggtaaatattgttatgagagttatattagaaaccatccacatacagaatgtatagattgtatttaatttactttttatctttttgtctggaatagattgcttatatatcatgtaatgctccaaataatatatcttctcctttaaaatccttttctggtgttttaactgcagacattgtaggattttcctctatgcatcaataagctatttatatttcgatccccacattcagtaaaatcaaatatgtgaactcaacactacgtttaactaagaagttcgatccattacaaaaacaaaactattcctttactgatgccgctaccatcagaggccttggttcatttcattccatacgcaaaacaatatactgcaaacagcattcaacattttgagtttaacaattcagttatccatctatacattccaccactgcaaactacaaaaggtaactttcttcaccaaacgaccatagcttgtgagtttctgcagatattttgcaaagagagtgaaggaccgcgaaatatggtcatcagcttgaagaaccatcatccaaacagtgatcccagattaacttcaagttgtcttccagcattttaagcaccaggttttcgtcaatcgtttcctcctgcattttaggtaagaaaatgtattaaattaattatttcagtagtgaaggggtcaagtagaaaaagaaacagaaaggcttatcaactggattggaatcagtcattgaattttgtttctccagctgaactggatgatgttttgcccaaatgtattaccaatagaaatagacataattgctcattagaagaaaatctacctgcaattgggataaaatcccagacattttcaggttaacttcctgtgcaacctcaccagttgaagatctgaaatcatatcgatctgcatgtctaagcttaagcctaattgacgaattcccatacgattttgcagttgtgtgccagacaccggtaacagcatatcgactccctgaagaatcctcgccaaagggccatctcagcccacccttaacttcagagtccaacacagctgaaccgataagacttttaatttcattgatctcctcatcctgggaaaaagcagagagtgatacaataagaacacaaacactactggtgtcctttcagttgagagtgcagaagtcatgatgagaagatggaaattgaagtgcaaataaaataattcacacagaaaaaggttcttcttcgctggaatggaggtaaaatatgtacatccaaagtgcagacaaatttcatcggtactctaaaatctatgggttttgttaatacctgtacttaccaatgtaaatatcaaaagtatcatccctggtacactatatgactagacaatttaaatacattagacttgaaagtctgcttacttggggtgtaactttatatttggttgggttttcgaagcccttaaatcttattaagtgtaggtagttagagatcccaaaacaaatcaaattcattaagtaaccaccttaacactgaatgcatgtgaagaatatcttcatttctactttttgcctctgtatcctttttcctttttttctctcttctacttaccctcctttgtatttcatcgtagaaatgatttgtatctagctcaatccagttaccagagatctccaataacgcacagtatttgagcattttaaaccctactggtcaacccaataggctattcattttgctgttcacaaaaatcaaaccctctcccaaatcgacgaaacatgaaaaaacaagaaatttgaaccaagagtaactgaataaacatgtctccagttcagaagatatcaaatattgggtgaaacttctaagtatgagtatacgacctatgactttcaagatatttgatcctcaatgaagtaacttacagataaacccgtcatgattttcttggtgtttaacatcaacctcaggtctaagcttttgccaggacagctcatgtctgcaaccatgttgcgtacttggttcagctcaatctaaaagaaaaagtgtagcgtcagaagattgataaggaatgacaaactgcaagaagtaaagcatgcaaaagataggtaagaggaggtaaatatgttcatgacaacaattaatgttgtttttctagttggaaaataaacagttaattgggcatcttacagcaagttcattaagaaccagggaatggagaagtaaccttatggagctgaattttctcctgatccttgaccaccgtacatttgcaggtgacagttgaatcagcgcgcatgttgtctgaaagctacaaagcacaagggatactactaaaagaagcaacacataaagagaaagaaacttgttagaaacatgaaaatattaccttgacgtagtataattccttctcctccacatattgtaagtcaagtttttcaactgcaaggtttcgtatatattccatgtatgaaagaggaacactggtatagaaagattttctcatttgcctcaaggtagtttcctttaataggttactattgagggattcttgactttttgcagaaatcctacaagacagagaatttgaggaggattacatgttaaacacactggatttaatcgactcaacaaagtagtgcttcagacatcgccaaaagaagaaacattctaacacgtaggagaaaagttaaaagagttacatgtcaaagtaaaataagtcagcgatttacagaagttgtagtttgctttaccagacaagaaaattgtgtagtataataaaatggatttgaataaaagtgattatgagaaatggacaatactaacccatgaaagagaattcttccaaaacgagcaactagactcggctttgattcttcttccatattagattcctccattacagatttgacatgttgaaatgacaaaagtaagtcttccatcacatttttagccaccaaacgccatggctcatcattcgttcctccattgcaacctcaaaaataga

SEQ ID NO: 982 - DNA, 14358 bp, Solanum lycopersicum
atggagcgtatggctatcgtgttgatataagttttcttgggacagtaatctaatcttatgaaaagaacataaaaggaagtgttgtagcaaggctacatatataatttttttctccgatgtacctcaatgttatttttctattgaatcattgaatcacctataatatatttcttttaaacaccgttggctgatgtgaaatcaggttttgcgagggatattgacagaggatacatatgttgttccaaaactcattagttcaattgatagtgaaaacgttcgagaataattgtgttttacttcaaatcatttgaacacattagaaaacaaatgagactttgttggaattttgacccccaaatttgcctaaggaacaagtatattctatatgtttctttgcagattataacagttacgttttgcgaagcaaataaaataatgacacaatattttattgttaaaaatctcaactcataaggggtaaaaattacaacttacgactctgtaggatttaactccactttattaaactccgaacctcaacaaaagattacaagcctatttaacctaaggaattataaactctaattccaagctaagaaattataactctaattcctagctaaccaagacaaaaccccccaagttaagtcttctaccgtccgtcaagtttctcaaacttgttagacgaatcctacacacgcacttaactgtaatcaaaactcttaattacaatcttacaacttttccttacaaattggcaacactcccaagtaactctcaaaactctctcaaacctcttgatagtgttttgatctgctctctatgtaagtacgcaaatttttcttataaaatagctccctatttatagatcggaatttcaacaactccttgtttgattcaacttcttctttgcctctacaaaaccttgttgaactcaacttggacttccttttgtcttttccgcaacaaaaacttatgcttctttccttttaaacgatgccgcctcaaactatttccttaaacaagtaggaaacaattttccttctttgtctggaccgcctcaaactatttccttgaccaagtaagaaatagtttttccttctttacttaaacctagtcgaacccaacttggattaagtaataacttgtacaaacacgctttctgatttaacttggattcatcaaagacgtgttactgcctgcgacatgttactgcctgtgtcttcgccgctatacaacttgtcttcctatgttactgcatgtgtctttgccgctatacaacttatcttcgcaactacaacatgttactacctgtgtatatacaactttgtcatagttcataagaacttcttttcacaattaactatagaaactattttccttaaataagaaaactctattgaaacttattccgtcgtcgacttggttagcacaacctatcacgttagcagcacaacctattctacgtactttgtcaatcttcaaaataatcagcaattctagcgtctgacagactaacacacagtttgtcttcatcccttaaatcaagatcattacaatgcgaacataattgaagacatttacagtaaaaaagccgatcaaaatccaagaattgtttagacatctaattggttaataactgaaaagttgaaaaatagagatataatacataaatatgacctatagcttgacattagttgataattatgacccttgactttgaatacacacaagtagacatttaaacttgtatgaaattgaacaagtaaaaacatatgtcctacgtgacatgatacacgtaggacacaaaattctcatgtagggtgtcatgcaagacaggtgtgtctattcaattttatacaaatttaagtgtctacttgtgcacatctaaagtcaaggctcataatgcaaactgaggccaagttaaaggtcatgttcatatattataccaaaaaacaaaagttacctataaacaaacaaataaaatggaagtaaatcgcacatgtgaagtcccatgattttaattattagtcgatagaagatgttgcttaattatatagctgtaaaagctaatttatgaatctctcctcaaattccaaaatcttatcccaactaaacagtagaaattaagtattaatttcaattaatagaaaagcattcagcaaccaagtggagaatttggtatctgttggttcttcttttggaaacgaaagaaatggactaatgccaaataataatatttaaagtaaaaagcaaattactttatgagtttcagttatcactcacaaactgtttaatctaatcaaggatggaagtatttattataattgctagaaatggacactattttccactaaaagaagggaaataagaaatgatcacctcttttctggacataagtcattttccctcacaattagtcttttaactaagtatttagagtattctaagatttatgaatattgtgacaaatttaaaattcgtaagtttagattctatcttttgacccatcaaaccaataaacagatttgaaataataaaaacatatatttgatgaatattcttcaattgcacaatttcagccaatgaaaaatctatattcttaagtagttagttttatattttgaataatactagaaaagacatttctaaaaaatatcttggcaagaaacgcacaggttttagatttgcaccacataattgctttattattataacaaaccacatggatgaagacttgtctaaaattttataccacaaaaccatcaaaaaatctaaaatcagtctttatttccctcaacaaggtctctctcctctttcattttggtggaaatattaagtggccaaactcgtagatgaagtacttttctaatataaactatgaaaaaatatttagcattttaccacgatttttattgataagtttggaaatatattattttttgtcgaattattttctggctgtgttctggactacgttgtacagtgtatgccatttaattttattttgaatgttctattttttgtttttgtaggctagtcaatttcaaaatatcctaaacctcatgttatggtattttgtttgttccatttactaccccacaaagaaaccacaaaaccgtactgtgattttttatttttttttaaagattttattatttaatgtatcgttatttatttgaaatagtactttaatattattaaatatagatatatccttctttttgtgaagatcacttattattaaagttctaatacttaataatcaccacgagctatctttgtacaattactatgcaaaatactataaatagtaccactaataattacctccaacaccttacaactctactactattacaattcacaatcattatcactatcattatcagttattataattgcgttactatatattatcacaatgcagccaagataatcaccagttcacaccagctatacatgcccatatcaaatcatagtttatttcaaccgtcatcagtgttaagtatttctaaaattactagttactatcatcaacaattagcttccaatcttttcacaattacagttcactgcgcccgctcctttaaatttaaagggcggcggcgttcaagcttaccttattattagagaaaggtttggaacgaagtagcctttgttgtttgacaatcaccactattaactaatattgtcactagctatttacgataaattactaccacataattactcccatcacttaataacctaatatgcatacaatatttaaattgtgggtttattaattttgtcatttgaggaaataaaaactatataattagatgtaaatataacatcttgacatttaaagacatttgaattaaaaaaaaacaatccttaaattttaaaaacttcgtcgtttcctcttttttataccactagatagagtccactatcggattaatttggattctcctacatataagcctaaaaaaaatacaacgaactagctattaaaaagaattttattttttgagaggtaaatttcaaaatagtgtaaaaagaaaaatctaatttgacttgatactaaattaaagaaatacaaatgtataagaaagaaaatgatgcataagtcaagcagctaaaagaaaatatccaccatttatgagtgaacaagagtcaaagatctggctgagcttagtcatacaaagaagcaacaatgagaagccacctggccatggaatctacatcattggtgctgcttaatgcatcatggattggttctcaatcttcctctgccccaccaccaccaccctcactatcacccacaaacttccacttccttttcaaatgcctaacaaacaaacattggcctaattaacaactcccatatatcatctaacttcttcttttcactgaatcatatattacttgtttggatatcaatcttccttgccccaccaccatcctcactttaacccacaaatcccactttctttggcctaattaacaattttttcaataaatcttcttttcactgaatcatacatacattggaagaaaaactcaaatcttcttttcttgaactggggttcaattaaaagatgtattcaactgttttttacacttcagtgcatccttccacttcagttttatcaagaaagcagctacctttattgatttccaaggacttttctgcagagttatatcattctttaccttgtaggagcttggaaaatgggcatatcaacaaggttaaaggagtaaaagtaaaagcaacaattgctgaagctccagttactcctacagagaagactgactctggggctaacggtgatttgaaggttccacagaagaagttgaaagtacttgttgcgggtggtgggattggtgggttagtgtttgctttggcagcaaagaaaagggggtttgatgtattggtgtttgagagggatttaagtgctatcagaggagagggacaatatagaggtccaatacagatacagagcaatgcattggctgctttagaagcaattgatttggatgttgctgaagacattatgaatgctggctgcatcactggtcaaaggattaatggcttggttgatggtatttctggcaactggtaaattcacatcactatgatttctttgtgctaattaggtgcttgtttatgctttactctgatatgttttacttgagtcgacatcaaaagttagggataccaccctcctcagaacccactcgtgtgcttgtccgaagagaaactcttggtgttatttaacagtaacaatcatacacaagcttttactaaggataactgaagaagataatgaaatacttaagtctttcagaaaattatactgaaattatttgagggaaaataattcatttagtgaaaagtttattgagtcatagttgttgagcttattccggaaaaggatccatatttacctgcaatcagattggtgaattggtctcgttattgtatgaacagctttattatgagaacagttcctttttagttcttgaactgcacacagtgacaatagttggttttcaggtattgcaagtttgatacgttcactccagcagtggaacgtggacttccagtgacaagagttatcagtcgcatgactttgcagcagatccttgcacgtgctgttggtgaggagataattatgaatgaaagtaatgttgtagactttgaggatgatggagagaaggtatctggctatttccaaaactcaaaatatcaagaaagattagaacttctgttagtttcatttaagattgtgtcgatcagtgtcaatggtagctaattgttgtgtcttattaatcaattttcattatagcttctcatgtttgtgtgaaatcaggttactgtggttcttgagaatggacaacgatttacaggtgatcttctggttggtgctgatggcataagatctaaggtattcaaaatcagtctcattctatttccttctaatattgctacttgtgttgattacaaggatagagtaacttgtccatatgttactttgagattgtggtccatgttaaaaaagtagttggtcaattcggcttggtttagaagatctcaaacattggtgtttattgtaggtacggactaatttattcggacccagtgaagctacttactctggctacacttgttatactggaattgcagatttcgttccagctgatattgatacagttgggtatgatattcttacttatcggattgtcttttccctcttcatgtccttagctggtccccttatgctcatgctatgttgtcatagtaaaggttaaattcagatttcttttctgaaggtaccgcgtctttttgggccacaaacagtactttgtttcttcagatgtggggggaggcaagatgcagtggtatgcattttacaatgaaccagctggtggtgcggatgccccaaacggtaagagtttttaggccgtttgtagttcaggatataaacgtgcttactagaagacgtttctgaatgcttgacttgttaagtaatgtctatataacccaaggggtttctcgaggatttttccttgttgagacctgattatagtgctgcaataaggtaaagaagaagtcaagattagaatgagatagattcaatgaattgtgagttggaaagttttgaattgaagtgctgattcatgcataatctaacttttggtaagcagttgcactcttactcatctaattcatttctgaagagtttcagagaatgatgcaccacaattctttgtttctactcatagatgtgaggtccttacttcatcacagaaattgtttattaacttgtatatgaaacgcatgtcttattatattgttgtagtagtaccagtttggataaaagaatcacaaacttttggggggttggcactacatgagatgagtatggtatcttgacactctaaattgccactatgatgctcaagaggttaggaaatatatgtagtcatattgtcattacattggttgtcaatagtttatctgttcatgctgcaggtaaaaaggaaagattgcttaaaatatttgggggatggtgtgacaatgttatagacctattagttgccacagatgaagatgcaattcttcgtcgtgacatctatgatagaccgccaacctttagttggggaagaggtcgtgttacattgcttggggactccgtccatgccatgcagcctaatttgggtcaagggggatgcatggccatagaggtacattctttatagtaaccttttttacttcacttaattaacatggtattattggtcgattctatcccttagtcccttctatctaagaactaagaagtagggtattattgttatgttgtgtaagccactgaacgtttccttttacaactacaggatagctatcaactagcactggaacttgaaaaagcatgcagtcgaagtgcagagtctggaagccctgtggatatcatctcatctttaaggaggtaatccattatttattggctcaagtgatgtatagtggttgcttgaatacacgctgtttgacaattgaaaagtcatttaaaattggctgaagtcttaacttcaccttaccaccagccaagaaagcctgctttaaatgcctaaatgaagatgaattgacttgaacaacttctgtttctgccagttagctgatccttttatgattttctgtatccacagctatgaaagtgctagaaaacttcgagttggagtcatccatggactggctagaatggctgcaatcatggcatctacttacaaggcttatcttggcgtcggacttggtccactatcagtatggaaatctgtctctctttgaaatatgagtagctaagttgtctgatttagcatagatcttcttatgatatggatttggatttctatcattttttgcagtttttgacgcagtatagaataccacatcctggaagagttggtggaagagtttttattgacttgggaatgcctctgatgttaagttgggttctaggaggcaatgggtagggaatatgcaggccttttcttggttcaatattttaaacatgaacttgattttacttatgtgatcagcctatagctagagagtgaaattgcaaagccatatatttatttttacttctaatgcttcttgcggtgaacccttccttttatcacagttcaatggttcatgattattctgttgattctgtttagtcggaacttttactcgaaattcttttattgtacctaagcttcaaattattagttcttttttgttcggaaaaattagaagttgagctttccctcatccttgatgagttcaatggattcttggaagttgataaactagtagtttgactcggctttttttttcttgcagggacaagcttgaaggcagaataaaacattgcaggctatctgagaaagtatgtagactaaggaattatgcacataaaaaattgtggtttccattgttacataattaacaagtatgaattttatgggagtattaatacactgtattgtggtaatgaaggcaaatgaccaattgagaaaatggtttgaagatgatgatgctttagagcgtgctactgatgcagagtgagtttgacaagcttaatctttacaaatttcatttatatgtatgtcctgtttttcttgtttgcttgctaattttgatgcttaatttttatctttcaggtggttacttttacctgcggggaatggctcttctggtttagaagctattgttttaagcagagatgaggatgtcccttgcactgtcgggtatgcttttaggttatggtttattggatttaagattgttcatagctgactgttacgtctttgtggcacatagtttaaaagatttaaatagttcaagtcattttattacttagctctcgacataatcatacactatggtgtgcatcagttgcaaatatttcaccatcaatctcctctaatttacacatccaatccatgcacatactttcaaaactgtgaaccagacaaaaaatgaatttcacttggctgtaaagggagaatgtataacgcaatattgttttattagaatagtcactgacaggcttttggtttcaggtccatctcacatacaaatattcctggaaaatcaatagttttacctttgccacaggtgattgccatattattctatagctcagtatcctggaccttcttctggtgaatgcatgattgaattgtcaaatttcttttttaatctcaggtatctgaaatgcacgcccggatatcatgcaaagacggagcattttttgtaactgatttacgaagtgaacatggtacctgggttacagagtaagttccatgtgttcctgtatacaactctactattagatatcccattttatgaaaacaatagttacgattgatctgcgttatcatgtagtaatgaaggcagaagatatcggacgtctccaaacttccctacacgttttcatccatcagatgttatcgaatttggttctgataaggtgagattcatcaaagtattttctctttaacgcaaaactttggcattagcattattcttttaaaccgtcatgtgcaggcagcatttcgtgttaaagcaatgaaatttccactaaaaacttctgaaaggaaggaagagcgcgaagcagtggaggcagcgtaaagcttgacctgatataaacaggaaattgtacagcattttatagcaaacatcaggcgttgagcaatttaagcatagttaattttgtatactgtaggttttagaaaagatccataaacaagacaccatgaaagaaaatacagagattctcctaaagaaatctggagaatgtcatggacattgtctcttattctaccattgctaaaaatatattacttctctatgtatatacaattatagtctagatctacttcataaatattttcgtatgacaagtcttcaatttcaaaaattaactgctaatttataacaaaaaaaattatatgctccaattacgaagttaatgttagtagttgactgacattgaaaaagcttagaccattgtccaacgtccatattgcacaacatactaggtttacacagttcaatttgtgttggattttgccgtaaattttggtgagatttaatttatgttatattttataaaaatatttataagcatattttttcttcagaagttttctcggaaaaaaactctttaaaaaaaattaaaaaaataattctaatgcttttcagaaatatttattattttcacccgcttagacaaataaaaaaatgaacgtttttgtaagtaaggagaaaaaggacttttgaattttgagttcttaaaaattggccggtcaaataagctacgtccaaaaaaatcaattatccaggaaattcaaaatagtataacaagtaaagaaaattacaatgcaccattttttacatttgaattctagatagctagatgattagttttgaaaaaggttatttaaatttcttaaaatatcattcgacctaactctcatcccaaaagttagctcaaagggaggagtaaaattaggtcttaggtctaactcacacccaaaagctagctcaaagggacaaagattgtctaagctttataaagagttcacctatctcattaatcattcatgtgagacttttgtcattctttaacaacccacctcacgcctagtgcttagcatctggtgtgtggtaattttttattttggggccctatcatcgggtgagacggaccctgctttgataccatgtgaaattaggtcttaggcttaactcacatctcaaaagctgctcaaagggagaaggattgtccaagccttataaggagtcacccatctcatgaatgatcaacctatagcaccttcatcaatagctccctctctcagaaggacttccagaaccatcaaagagccttctgggatgctggactacaccatctccacaaagaaaaacagtattaaacatctttttggccaactatctgtgttatgacaataaaactccttgctataggagttacttgagcaagttcactattcctattgcagaaccaaaatgctacagacaggccattaaggatgagaaatggatccaagcaatgaaacaagaaattcaagctcttgaagataacaaaacttggttagttattgacttaccaaatgggaagaatactgttagctcaaaatgggtgtataaagtcaaatataaggccaatggtgagatggagagatttaaagccaggctggtggtagagggatatagccagcaagaagggtgggattaccatgacacattctcaccagttgccaagatggtgactgtaaggtgtgtgattgtattgactgtatctaaaggatgaaacttgtatcaaatggatgtctataatgtctttctttaaggtgatctagatgaagagctgtacatggaaatgcctgaaggttttagacaaccaggagaaactaaagtgtgcaaattacttaagtcataatggccttaaacaagcttctaggcaatggaacttgaagatcacaaatgctttattggacactagttttacccaatgtgctcatgattactccttgtttacactaagaagaggtgaagctttggtccttattcttgtttgtgtggacgatttgctgatcaaaggaaataatgaacaacttatcactgaagccaaaaacagtttgcataaggcgtttaagctaaaagatttgggtgagctcaaatattttttgggaattgatgttctcagatctcccaaaggtgttgttttgaatcaaaagaagtatatctagagcttattgcaaattcagggcttactggtacaaaaccaacaaccactcccattgaatccaacgtgagacttacttcagttgaacatgacttagtaactggctatactgaagatgaggttctacatgacatttctccttatcaaagattgattgagaagcttatctatgcaaccattacaagacttcacatcggctatgcagttcaaactcttaactaattcatgcaatctcccaagaagtcacattgggatgcagttactagagtagtcagatatttgaaaggcacaataggtcaaaggtctgactacaagttaaacctgccaatatgatcacctgttggtgtgactctgattgggcatcttgccccaacataagaaggtccattacgggaaatgtagtcaagtttggtgaatcattggtgtcttggaaatctaagaagcagcaaactgtctcaaagagttcagctgaagcatggcttcagttgtttcagaaatcacttggctgctaggcctttttacagaacttggtgtctcaattcacatgcttgttaccatctttagtgacagtaaatcggcaattcaattatcaaccaacttaatcttccatgagagaaccaaacacattgaaatagattgtcattttatcagagataggattaagtcaggcatggttgagattgttcatgttcctacacggcaacaggttgcacatctactgactaagggattaagtcaagctcaacattcttatcttctagccaagcttggcgtgctcaatgttatgcaccctccagcttagggggggtgttcgagtgtgcattattgtaaatcagtttttactgtttacattcaaatgctagttaattggttagttaaatgtgttagctggcaatatgattagttgagttagttagtcaggtcattttggtttgattcttctagattgatttccgcatctataaaacattgtattttcatcatattgtaacagatttctcaatacatgaaataaaatgttgggttttaaaaggtgtaaatggaaaatgaaagagttgtaatttttatgaaaagttgtgacttttatgaaaagttgtgacttttataaagggtgacaacctttccgaaagattgttactttttcaaaagtttgtgacctttccgataaggcacaataagaacatctccgtattcttatttgttttctataaattgagtgatttcctctcattttaaaaatagaatttatggacttcttcttctactactaaatctagtattctaagtgtatattattgtcgttgagtgactcgctgacaccagcgttttggtatcaatacactggtgattgagatcattctatcctaggaggacatattccaaatcaaaacctcggataatagaggagaataatttccttaaggggacattgtgcattcagtgagtttgatcttctttctgtttttctaaattctgatatgttttacaaattttagatttgtaaattaatttatgttctttggttcttcactggttcgttaaactttggcaacttcgtgtttctacaaagtttgttggaatcagtaagattctttaaacacagattaacaacaattcttctttaagaaaaatatttcatatatttttttttcttatctgtttctgtatctagttttaattttctagttgtgaaaatgttcttaaactttgttggcttaccaagttcttcaaagttttgttctaagtatgttaggaatacaaaaggcaaaatagtccagtggaccctcgtacttgtatcggattgtattatggactcttctacttagctttttgtcacctggactcctgaacttaaccaaaatgagatttttaaatccctctaaccatgggtgtatctcactctcccttacatagatgacatgttagatccatgtcatatatattaatgtcaagtcataattttcttcataataattttttaattattagtaaaaatatgaaataaaagacaaattttaaaaaaatctattttattttataaaataattatttttgtacacctttactctacctttcctaacccatcatcactgtcaaaactccaccatctccatatccccatttttttcttcttcgattttttcacaatccagcaatctgatagtcatgaaactacttcactccccgctagtgccattttaattttattattgacatttctaatcctccctattttcactatttcaccactaagccggcgtcgtaaaacccattaaaattcaactgtaaaacccaatatagcatttccaattttacggcatggatagcaatacaaattggtcggaacaaggtagaggatctcgtcgatgccgcataaatgatggagccattgcgtcatctccattttttacggcagcgtctatcgccatttttactggcgtaacaacaacctaagtcatctaacaaccacaataacaacaagaagtcacctaacaaccagatctaaccaaacttttttcataatccaagctaactgctatttcacacc

SEQ ID NO: 983 - protein, 276 aa, Solanum lycopersicum
MAQTMLLTANAKVDLRSKESLVERLKPKPLSSLFLPSLPLRFSSSSTNASSSKFTSTTVALFKSKAKAPPKKVAPPKEKQKVEDGIFGTSGGIGFTKQNELFVGRVAMIGFAASLLGEAITGKGILAQLNLETGIPIYEAEPLLLFFILFNLLGAIGALGDRGKFVDDPTPPTGLEKAVIPPGKSFKSALGLSEGGPLFGFTKANELFVGRLAQLGIAFSIIGEIITGKGALAQLNFETGVPINEIEPLLLFNIAFFFFAAINPGTGKFITDEEED

SEQ ID NO: 984 - protein, 478 aa, Solanum lycopersicum
MALAPHSNILCNHEAIKCQVGSRLQSHTRFSWGRADYFGSIVLVKICSRRQIPTYLQKSSRICCGLDSRSLQLSSRGKQNLSSAHRINQNVPKGNTIWKFPEDVALMVLKKWGQLAKTAIVTIFILSVASKADAVDALKTCTCLLKECRIELAKCISNPACAANVACLQTCNNRPDETECQIKCGDLFENSVVDEFNECAVSRKKCVPRKSDVGDFPVPDPSVLVQKFDMNDFIGKWYITRGLNPTFDVFDCQLHEFHTEGNKLVGSLTWRIGTPDGGFFTRSAVQKFVQDPKYPGILYNHDNEYLHYQDDWYILSSKVENSPDDYIFVYYKGRNDAWDGYGGSVLYTRSSVLPETIIPELQIAAQKVGRDFNTFIKTDNTCGPEPPLVERLEKKVEEGERTIIKEVEEIEEEVEKVKEKEVSLFSRLFEGFKELQQDEENFIRELSKEEMDILDGLKMEATEVEKLFGNALPIRKLR

SEQ ID NO: 985 - protein, 669 aa, Solanum lycopersicum
MYSTVFYTSVHPSTSVLSRKQLPLLISKDFSAELYHSLPCRSLENGHINKVKGVKVKATIAEAPVTPTEKTDSGANGDLKVPQKKLKVLVAGGGIGGLVFALAAKKRGFDVLVFERDLSAIRGEGQYRGPIQIQSNALAALEAIDLDVAEDIMNAGCITGQRINGLVDGISGNWYCKFDTFTPAVERGLPVTRVISRMTLQQILARAVGEEIIMNESNVVDFEDDGEKVTVVLENGQRFTGDLLVGADGIRSKVRTNLFGPSEATYSGYTCYTGIADFVPADIDTVGYRVFLGHKQYFVSSDVGGGKMQWYAFYNEPAGGADAPNGKKERLLKIFGGWCDNVIDLLVATDEDAILRRDIYDRPPTFSWGRGRVTLLGDSVHAMQPNLGQGGCMAIEDSYQLALELEKACSRSAESGSPVDIISSLRSYESARKLRVGVIHGLARMAAIMASTYKAYLGVGLGPLSFLTQYRIPHPGRVGGRVFIDLGMPLMLSWVLGGNGDKLEGRIKHCRLSEKANDQLRKWFEDDDALERATDAEWLLLPAGNGSSGLEAIVLSRDEDVPCTVGSISHTNIPGKSIVLPLPQVSEMHARISCKDGAFFVTDLRSEHGTWVTDNEGRRYRTSPNFPTRFHPSDVIEFGSDKAAFRVKAMKFPLKTSERKEEREAVEAA

What is claimed is:

1. A method of providing a modified tomato cell having a modified genome, comprising effecting in the genome of the tomato cell targeted modifications in at least two genes, wherein the targeted modifications comprise an insertion of a predetermined sequence encoded by a single-stranded DNA donor molecule, wherein the predetermined sequence comprises an enhancer element, wherein each targeted modification is achieved by integrating the predetermined sequence comprising the enhancer element by non-homologous end joining (NHEJ) at one or more site-specific double-strand breaks (DSBs) introduced at about 50 to about 500 nucleotides upstream of the start codon of the coding sequence of the two genes; and
wherein the targeted modifications are effected in a tomato cell by site-specific effector molecules comprising at least one CRISPR nuclease, at least one guide RNA, and at least one single-stranded DNA donor molecule encoding the predetermined sequence, wherein the single-stranded DNA donor molecule has a length of 18 to 300 nucleotides and does not have homology arms; and
wherein the targeted modifications result in an increase in expression of the first gene and an increase in expression of the second gene relative to a tomato cell lacking the modifications, wherein the at least two genes are associated with the same trait, wherein the trait is selected from the group consisting of abiotic stress, architecture, biotic stress, flowering time, nutrient use efficiency, photosynthesis, resource partitioning, and senescence; wherein, after the targeted modifications are effected, the modified genome is more than 99.9% identical to an unmodified genome of the tomato cell; and wherein the targeted modifications improve the trait in a tomato cell comprising the targeted modifications relative to a tomato cell having an unmodified genome, or in a tomato plant grown from or comprising a tomato cell comprising the modifications relative to a tomato plant lacking the modifications.

2. The method of claim 1, wherein, after the targeted modifications are effected, a loss of epigenetic marks occurs in less than 0.01% of the genome.

3. The method of claim 1, further comprising the step of growing or regenerating a modified tomato plant from the modified tomato cell.

4. The method of claim 1, wherein the trait is flowering time and the two genes are: (i) a gene that encodes a protein having the sequence of SEQ ID NO: 769 and a gene that encodes a protein having the sequence of SEQ ID NO: 771; or (ii) a gene having the sequence of SEQ ID NO: 427 and a gene having the sequence of SEQ ID NO: 429.

5. The method of claim 1, wherein the predetermined sequence comprises SEQ ID NO: 184.

6. The method of claim 1, wherein the targeted modifications are obtained without a step of separately identifying an individual modification and without a step of separately selecting for the occurrence of an individual modification among the targeted modifications.

* * * * *